United States Patent 11,596,699 (RNA ENCODING AN ANTIBODY) - sequence listing, part 11

SEQ ID NO: 61366 - RNA, 1353 nt, Artificial Sequence
  derived and/or modified sequence opt4 from CDS (HC) w/o signal peptide encoded by mRNA R5319
caggugcagcuggugcagagcggcggccagaugaagaagcccggcgagagcaugagaaucagcugcagagccagcggcuacgaguucaucgacugcacccugaacuggaucagacuggcccccggcaagagacccgaguggaugggcuggcugaagcccagaggcggcgccgugaacuacgccagaccccugcagggcagagugaccaugaccagagacguguacagcgacaccgccuuccuggagcugagaagccugaccguggacgacaccgccguguacuucugcaccagaggcaagaacugcgacuacaacugggacuucgagcacuggggcagaggcacccccgugaucgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61367 - RNA, 1353 nt, Artificial Sequence
  derived and/or modified sequence opt5 from CDS (HC) w/o signal peptide encoded by mRNA R5319
caggugcaacugguccagagcggcgggcagaugaagaaacccggagaguccaugagaaucucuugccgggccagcggcuacgaguucauugacuguacccucaacuggauccgccuggcuccugggaagagaccggaauggaugggauggcuuaaaccccggggcggggccguuaauuaugcgcgcccucugcagggaagagugacaaugacgcgggauguguacuccgacaccgcuuuucucgaacugcgcucucuuacagucgaugacaccgccguguauuucugcacaagaggcaagaacugugauuacaauugggacuuugagcacuggggccgggggacccccguuauugugagcuccgccucuacaaaaggaccuagcgucuucccccuggcuccuuccagcaagucuaccuccggcgggacggccgcucucggaugccuggugaaggauuauuuuccggaacccguuaccgugagcuggaacucuggcgcccugacauccgggguccauaccuucccugcggugcuccaaagcucuggacuguacucccuuagcuccguggucacaguucccucuagcucccugggcacccagacguauaucuguaaugugaaccacaaaccuagcaauacaaagguggacaaaaaggucgagcccaaaucuugcgauaagacccauacauguccgccuugccccgccccugagcuccugggcgggcccuccguguuucuuuuucccccuaagccgaaagacacccugaugauuagccgcacccccgaaguuacauguguggucguggauguuucucacgaggacccugaagugaaguuuaacugguacgucgauggaguggagguccauaaugcuaaaacgaagcccagagaggaacaguacaacagcaccuaucgggugguuuccgugcucacaguccugcaccaggacuggcugaauggcaaagaguacaagugcaaagugucuaacaaggcccucccugcucccaucgaaaagaccaucagcaaagccaaggggcaaccgcgcgagccucagguuuauacacugcccccuuccagagacgaacuuaccaaaaaucaggugagccugacgugucucgucaagggauucuaccccucugauauugcgguggagugggaguccaacggccagccugaaaauaacuauaaaacaacacccccggugcuggacagcgaugggucuuucuuccuuuacuccaagcugaccguugacaagagccgguggcaacagggaaacgucuuuuccugcucugugaugcacgaggcccuccauaaucacuauacccagaaaagccugucccugucuccuggcaag

SEQ ID NO: 61368 - RNA, 1353 nt, Artificial Sequence
  derived and/or modified sequence opt6 from CDS (HC) w/o signal peptide encoded by mRNA R5319
caaguccaacuaguacaauccggaggacaaaugaaaaaaccaggagaaucuaugcgaauaucuugcagagccucugguuaugaauucauagauugcacacuaaauuggauaagacuggccccaggaaaaagaccugaauggaugggauggcuaaaaccccgagguggcgcuguaaauuaugcacgaccacuacaaggaagaguaacaaugacuagagacgucuauucagauacagcauucuuagaauuaagaucucuaacaguagacgauacugcaguauacuucugcacuagagguaaaaacugcgauuauaauugggauuucgaacacuggggaagaggcacgccaguaauuguauccucagcaagcacaaaaggaccaucaguuuucccccuagcaccaucuucaaaaucaacuaguggaggaacugcagcacuaggauguuuaguaaaagacuacuucccagaaccuguaacaguaucauggaauucaggagcacuaacaaguggaguacacacauucccagcaguucuacaaucaucaggauuauauucauuaucaucaguagucacagucccaagcucaucacuuggaacacaaacauacauaugcaaugucaaucacaaaccaucuaacaccaaaguagacaaaaaaguagaaccaaaauccugcgacaaaacccacacaugcccaccuuguccagcuccagaacuauuaggagguccaucagucuuuuuauuuccaccaaaaccaaaagauacauuaaugauuucacguacaccagaaguaacuuguguaguaguagauguaucacacgaggauccugaaguuaaauuuaacugguauguagacggaguagaaguacauaacgccaaaacaaaaccaagagaagaacaauauaacaguacauacagagucguaucaguauuaacaguccuacaccaagacugguuaaauggcaaagaauauaaauguaaaguuagcaauaaagcauuaccagcaccaauagaaaaaacaauaucaaaagcaaaaggacaaccccgagaaccacaaguauauacacuaccaccuagcagagaugaacuaacaaaaaaucaaguaagcuuaacaugccuaguaaaaggauuuuauccauccgacauagccguagaaugggaaucaaauggacaaccggaaaacaauuacaaaacaacaccaccaguuuuagauucagacgguucauucuuuuuauauaguaaacuaacuguagauaaaucaagauggcaacaaggaaauguauuuagcugcucaguaaugcaugaagcacuacauaaucauuacacucaaaaaagccuuucacuaucacccggaaaa

SEQ ID NO: 61369 - RNA, 1353 nt, Artificial Sequence
  derived and/or modified sequence opt11 from CDS (HC) w/o signal peptide encoded by mRNA R5319
caaguccaacucguccaauccggcggccaaaugaaaaagcccggagagagcaugcgcauaucaugccgagccucaggcuacgaguucaucgacugcacccucaacuggauccgccucgcccccggcaagcgacccgaauggaugggcuggcuaaaaccccgcggaggagccguaaacuacgcccgcccccuacaaggcagaguaaccaugacccgcgaugucuacuccgacacagccuuccucgaacuccgcucacucaccguagacgauacggccgucuauuucugcacccgcggcaaaaacugcgacuauaacugggacuucgaacacuggggacgaggcacacccgucauagucuccuccgccuccaccaaaggacccuccgucuucccccucgcaccauccucuaaauccaccucaggaggcaccgccgcacuaggcugccucguaaaagauuacuucccugaacccguaaccgucagcuggaacucaggcgcucuaacaucuggcguacacaccuuccccgccguccuccaauccuccggacuauacucccuaucguccguagucaccgucccuuccuccucacucggcacccaaaccuauaucugcaacguaaaccacaaaccuuccaacacuaaaguagacaagaaagucgaaccaaaauccugcgacaaaacccacacaugcccacccugccccgcccccgaacuacuaggcggcccaagcguauuccucuucccgcccaaaccaaaagacaccuuaaugaucucccgaacccccgaaguaaccugcgucgucgucgacgucucccacgaagaccccgaaguaaaauucaacugguacgucgacggcgucgaaguccacaacgcuaaaaccaaaccccgcgaagaacaauauaacucaaccuaccgcguaguaucaguacuaaccguacuacaccaagacuggcuaaacgguaaagaauacaaaugcaaagucagcaacaaagcccucccagccccuaucgaaaagaccaucagcaaagccaaaggacaaccccgcgaaccccaagucuacacacuucccccaucccgugacgaacucaccaaaaaccaaguaucccucacaugccucgucaaaggcuucuaccccucugacaucgccgucgaaugggaaucaaacgggcaacccgaaaacaacuacaaaacaacaccacccguacucgacuccgacggcucauucuuccucuacucaaaacucacagucgacaaaucccgcuggcaacaaggcaaugucuucuccugcucaguaaugcacgaagcccuucacaaccacuacacacaaaaaucacuaagccucagccccggaaaa

SEQ ID NO: 61370 - protein, 470 aa, Artificial Sequence
  Protein (HC) encoded by mRNA R5319
MELGLSWIFLLAILKGVQCQVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61371 - RNA, 1413 nt, Artificial Sequence
  CDS (HC) encoded by mRNA R5319
auggagcugggccucagcuggaucuuccugcuggccauccucaagggggugcagugccagguccagcuggugcaguccggcgggcagaugaagaagcccggcgagagcaugcgcaucuccugccgggccagcggguacgaguucaucgacugcacccugaacuggauccgccucgcgccgggcaagcggcccgaguggaugggcuggcugaagccccgcgggggcgccgugaacuacgcccggccccugcaggggcgcgucaccaugacgcgggacguguacuccgacaccgccuuccucgagcugcgcagccugaccguggacgacaccgccgucuacuucugcacgcggggcaagaacugcgacuacaacugggacuucgagcacugggggcgcggcaccccggugaucguguccagcgcguccaccaagggccccagcgucuucccccucgcccccuccagcaaguccaccagcgggggcacggccgcccuggggugccuggugaaggacuacuucccggagcccgugaccgucuccuggaacagcggcgcgcucaccuccggcgugcacaccuuccccgccgugcugcagagcuccgggcuguacagccucagcuccgucgugacggugcccagcuccagccugggcacccagaccuacaucugcaacgucaaccacaagcccuccaacaccaagguggacaagaagguggagcccaagagcugcgacaagacgcacacgugcccgcccugcccggcccccgagcugcucgggggccccuccgucuuccuguucccgcccaagcccaaggacacccugaugaucagccggacccccgaggugacgugcguggucguggacgucucccacgaggaccccgaggugaaguucaacugguacguggacggggucgaggugcacaacgccaagaccaagccgcgcgaggagcaguacaacagcaccuaccggguggucuccgugcucaccgugcugcaccaggacuggcugaacggcaaggaguacaagugcaaggucagcaacaaggcccuccccgcgcccaucgagaagacgaucuccaaggccaagggccagccccgcgagccgcaggucuacacccugccgcccagccgggacgagcugaccaagaaccaggugucccugaccugccuggucaagggguucuaccccagcgacaucgccguggagugggaguccaacggccagcccgagaacaacuacaagacgaccccgcccgugcuggacagcgacggguccuucuuccucuacagcaagcugaccgucgacaagagccgcuggcagcagggcaacguguucuccugcagcgugaugcacgaggcccugcacaaccacuacacccagaagucccucagccugucccccgggaaguga

SEQ ID NO: 61372 - RNA, 1617 nt, Artificial Sequence
  R5319
gggagaaagcuuaccauggagcugggccucagcuggaucuuccugcuggccauccucaagggggugcagugccagguccagcuggugcaguccggcgggcagaugaagaagcccggcgagagcaugcgcaucuccugccgggccagcggguacgaguucaucgacugcacccugaacuggauccgccucgcgccgggcaagcggcccgaguggaugggcuggcugaagccccgcgggggcgccgugaacuacgcccggccccugcaggggcgcgucaccaugacgcgggacguguacuccgacaccgccuuccucgagcugcgcagccugaccguggacgacaccgccgucuacuucugcacgcggggcaagaacugcgacuacaacugggacuucgagcacugggggcgcggcaccccggugaucguguccagcgcguccaccaagggccccagcgucuucccccucgcccccuccagcaaguccaccagcgggggcacggccgcccuggggugccuggugaaggacuacuucccggagcccgugaccgucuccuggaacagcggcgcgcucaccuccggcgugcacaccuuccccgccgugcugcagagcuccgggcuguacagccucagcuccgucgugacggugcccagcuccagccugggcacccagaccuacaucugcaacgucaaccacaagcccuccaacaccaagguggacaagaagguggagcccaagagcugcgacaagacgcacacgugcccgcccugcccggcccccgagcugcucgggggccccuccgucuuccuguucccgcccaagcccaaggacacccugaugaucagccggacccccgaggugacgugcguggucguggacgucucccacgaggaccccgaggugaaguucaacugguacguggacggggucgaggugcacaacgccaagaccaagccgcgcgaggagcaguacaacagcaccuaccggguggucuccgugcucaccgugcugcaccaggacuggcugaacggcaaggaguacaagugcaaggucagcaacaaggcccuccccgcgcccaucgagaagacgaucuccaaggccaagggccagccccgcgagccgcaggucuacacccugccgcccagccgggacgagcugaccaagaaccaggugucccugaccugccuggucaagggguucuaccccagcgacaucgccguggagugggaguccaacggccagcccgagaacaacuacaagacgaccccgcccgugcuggacagcgacggguccuucuuccucuacagcaagcugaccgucgacaagagccgcuggcagcagggcaacguguucuccugcagcgugaugcacgaggcccugcacaaccacuacacccagaagucccucagccugucccccgggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61373 - protein, 210 aa, Artificial Sequence
  Protein (LC) w/o signal peptide encoded by mRNA R5320
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61374 - RNA, 630 nt, Artificial Sequence
  CDS (LC) w/o signal peptide encoded by mRNA R5320
gagaucgugcucacccagagccccgggacccugucccugagccccggcgagaccgccaucaucuccugccgcacgagccaguacgggucccucgcgugguaccagcagcggcccggccaggccccgcgccuggucaucuacagcggguccacccgggccgccggcauccccgaccgcuucagcggcucccggugggggcccgacuacaaccugaccaucagcaaccucgaguccggcgacuucgggguguacuacugccagcaguacgaguucuucggccaggggaccaaggugcaggucgacaucaagcgcacgguggccgcgcccagcguguucaucuucccgcccuccgacgagcagcugaagagcggcaccgccuccgucgugugccugcucaacaacuucuacccccgggaggccaaggugcaguggaaggucgacaacgcccugcagagcggcaacucccaggagagcgugaccgagcaggacuccaaggacagcaccuacagccuguccagcacgcucacccuguccaaggcggacuacgagaagcacaagguguacgccugcgaggucacccaccaggggcugagcucccccgugaccaagagcuucaaccgcggcgagugc

SEQ ID NO: 61375 - RNA, 630 nt, Artificial Sequence
  derived and/or modified sequence opt2 from CDS (LC) w/o signal peptide encoded by mRNA R5320
gagaucguccucacccagucccccggcacccucucccucucccccggcgagaccgccaucaucuccugccgcaccucccaguacggcucccucgccugguaccagcagcgccccggccaggccccccgccucgucaucuacuccggcuccacccgcgccgccggcauccccgaccgcuucuccggcucccgcuggggccccgacuacaaccucaccaucuccaaccucgaguccggcgacuucggcgucuacuacugccagcaguacgaguucuucggccagggcaccaagguccaggucgacaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61376 - RNA, 630 nt, Artificial Sequence
  derived and/or modified sequence opt3 from CDS (LC) w/o signal peptide encoded by mRNA R5320
gagaucgugcugacccagagccccggcacacucucccuuucuccuggggaaacugccauuauaucaugcagaacgagucaauacggaagccuggcuugguaucagcagaggccaggucaggcaccgcgguuggucaucuacuccggcucuacccgcgccgcggggauucccgaccgauucucgggaucacguuggggcccugauuauaacuuaacaaucagcaaucuggagaguggugacuuugggguuuacuauugucaacaguacgaguucuuuggacagggcacuaaggugcagguagauauuaaaagaaccguggcugccccauccgucuucaucuuucccccuucugacgaacaacuaaagagcggcacagcauccgugguuugccuccugaacaauuucuauccaagggaagccaaagugcaguggaaggucgauaacgcacuucagucagggaauagucaggagagcgugaccgagcaagacucuaaagauuccacuuacucacugagcaguacauugacccucucuaaggcugacuacgaaaagcacaaaguauaugccugugagguuacgcaucagggacuguccagccccgugacuaagucguuuaaccggggugaaugc

SEQ ID NO: 61377 - RNA, 630 nt, Artificial Sequence
  derived and/or modified sequence opt4 from CDS (LC) w/o signal peptide encoded by mRNA R5320
gagaucgugcugacccagagccccggcacccugagccugagccccggcgagaccgccaucaucagcugcagaaccagccaguacggcagccuggccugguaccagcagagacccggccaggcccccagacuggugaucuacagcggcagcaccagagccgccggcauccccgacagauucagcggcagcagauggggccccgacuacaaccugaccaucagcaaccuggagagcggcgacuucggcguguacuacugccagcaguacgaguucuucggccagggcaccaaggugcagguggacaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61378 - RNA, 630 nt, Artificial Sequence
  derived and/or modified sequence opt5 from CDS (LC) w/o signal peptide encoded by mRNA R5320
gagaucgugcugacccagagccccggcacacucucccugucuccuggggaaacggccauuaucagcugcagaaccucccaauacggaucucuugcuugguaucagcagcggccgggccaggcgccccgccuggucauuuacagcggguccacaagagccgcuggaaucccugaccgguucucuggcagccgcugggggcccgauuauaaccucaccauuuccaaucuggagagcggagacuuuggcguuuacuauugucaacaguacgaguucuuuggccaggggacaaagguccagguggauaucaaaagaaccguggccgccccuucuguguucaucuuucccccuuccgacgaacaacuuaagagcggaacagcuucuguugugugccugcucaacaauuucuauccgcgggaagccaaaguccaguggaagguggauaacgcucugcaguccggcaauagccaggagucuguuaccgagcaagacuccaaagauagcacguacucccugucuagcacccucacacuguccaaggccgacuacgaaaagcacaaaguguaugcgugugaggucacccaucaggggcuuagcucucccgugacaaaguccuuuaaccgcggagaaugc

SEQ ID NO: 61379 - RNA, 630 nt, Artificial Sequence
  derived and/or modified sequence opt6 from CDS (LC) w/o signal peptide encoded by mRNA R5320
gaaauaguacuaacacaaucaccaggaacauuaagccuaucaccaggagaaacagcaauaauaucauguagaacaagccaauacggaaguuuagcaugguaccaacaacgacccggacaagcaccaagauuaguaauauauagcggaucaacaagagcagcaggaauaccagacagauucucaggaucaagauggggaccagacuauaaccuaacaauaucaaauuuagaaucaggagacuucggaguauacuauugccaacaauaugaauuuuucggacaaggaacaaaaguacaagucgauauaaaaagaacaguagcagcaccaagcguauuuauauucccaccaucagacgaacaauuaaaaucaggaacagccucaguaguaugcuuacuaaauaacuuuuacccaagagaagccaaaguacaauggaaagucgauaacgcacuacaaagcggaaacucacaagaaagcguaacagaacaagacucaaaagacucaacauacagcuuauccucaacauuaaccuuaaguaaagcagacuacgaaaaacacaaaguauacgcaugcgaaguaacacaccaaggauuaagcucaccaguaacuaaaucauuuaacagaggagaaugc

SEQ ID NO: 61380 - RNA, 630 nt, Artificial Sequence
  derived and/or modified sequence opt11 from CDS (LC) w/o signal peptide encoded by mRNA R5320
gaaaucguccucacccaaucccccggcacccucucccucucccccggcgaaacagccauuaucuccugccgcacaucccaauacggcucacucgccugguaccaacaacgucccggccaagccccccgcuuaguaauauacuccggauccacccgcgcugccggaauccccgaccgcuucuccggcucccgcuggggccccgacuacaaccuaaccaucuccaaccuagaauccggagacuucggcgucuacuacugccaacaauacgaauucuucggacaaggcaccaaaguccaagucgacaucaaacgcaccgucgccgcccccuccguauucaucuucccccccuccgacgaacaacuaaaauccggcaccgccuccgucgucugccuccuaaacaacuucuacccccgagaagccaaaguccaauggaaagucgacaacgcacuccaauccggcaacucccaagaauccgucaccgaacaagacuccaaagacucaaccuacucacuuucauccacccuaacccucuccaaagccgacuacgaaaaacacaaaguauacgccugcgaagucacccaccaaggccucuccucccccgucacaaaaucauucaaccgcggagaaugc

SEQ ID NO: 61381 - protein, 230 aa, Artificial Sequence
  Protein (LC) encoded by mRNA R5320
METPAQLLFLLLLWLPDTTGEIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61382 - RNA, 693 nt, Artificial Sequence
  CDS (LC) encoded by mRNA R5320
auggagacccccgcccagcugcucuuccugcugcuccuguggcugccggacaccacgggcgagaucgugcucacccagagccccgggacccugucccugagccccggcgagaccgccaucaucuccugccgcacgagccaguacgggucccucgcgugguaccagcagcggcccggccaggccccgcgccuggucaucuacagcggguccacccgggccgccggcauccccgaccgcuucagcggcucccggugggggcccgacuacaaccugaccaucagcaaccucgaguccggcgacuucgggguguacuacugccagcaguacgaguucuucggccaggggaccaaggugcaggucgacaucaagcgcacgguggccgcgcccagcguguucaucuucccgcccuccgacgagcagcugaagagcggcaccgccuccgucgugugccugcucaacaacuucuacccccgggaggccaaggugcaguggaaggucgacaacgcccugcagagcggcaacucccaggagagcgugaccgagcaggacuccaaggacagcaccuacagccuguccagcacgcucacccuguccaaggcggacuacgagaagcacaagguguacgccugcgaggucacccaccaggggcugagcucccccgugaccaagagcuucaaccgcggcgagugcuga

SEQ ID NO: 61383 - RNA, 897 nt, Artificial Sequence
  R5320
gggagaaagcuuaccauggagacccccgcccagcugcucuuccugcugcuccuguggcugccggacaccacgggcgagaucgugcucacccagagccccgggacccugucccugagccccggcgagaccgccaucaucuccugccgcacgagccaguacgggucccucgcgugguaccagcagcggcccggccaggccccgcgccuggucaucuacagcggguccacccgggccgccggcauccccgaccgcuucagcggcucccggugggggcccgacuacaaccugaccaucagcaaccucgaguccggcgacuucgggguguacuacugccagcaguacgaguucuucggccaggggaccaaggugcaggucgacaucaagcgcacgguggccgcgcccagcguguucaucuucccgcccuccgacgagcagcugaagagcggcaccgccuccgucgugugccugcucaacaacuucuacccccgggaggccaaggugcaguggaaggucgacaacgcccugcagagcggcaacucccaggagagcgugaccgagcaggacuccaaggacagcaccuacagccuguccagcacgcucacccuguccaaggcggacuacgagaagcacaagguguacgccugcgaggucacccaccaggggcugagcucccccgugaccaagagcuucaaccgcggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61384 - protein, 457 aa, Artificial Sequence
  Protein (HC) w/o signal peptide encoded by mRNA R3059, R3061, R4116, R4634, R4635, R4640
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61385 - protein, 221 aa, Artificial Sequence
  Protein (LC) w/o signal peptide encoded by mRNA R3059, R3061, R4116, R4634, R4635, R4640
SWAQSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61386 - RNA, 1371 nt, Artificial Sequence
  CDS (HC) w/o signal peptide as RNA from mRNA R3059, R3061, R4118, R4634, R4636, R4640
caggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaag

SEQ ID NO: 61387 - RNA, 663 nt, Artificial Sequence
  CDS (LC) w/o signal peptide as RNA from mRNA R3059, R3061, R4118, R4634, R4636, R4640
agcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcucc

SEQ ID NO: 61388 - RNA, 1371 nt, Artificial Sequence
  derived and/or modified sequence opt2 from CDS (HC) w/o signal peptide as RNA from mRNA R3059, R3061, R4118, R4634, R4636, R4640
cagguccagcucguccaguccggcgccgaggucaagaagcccggcuccuccgucaaggucuccugcaaggccuccggcggcaccuucaaccgcuacaccgucaacuggguccgccaggcccccggccagggccucgaguggaugggcggcaucauccccaucuucggcaccgccaacuacgcccagcgcuuccagggccgccucaccaucaccgccgacgaguccaccuccaccgccuacauggagcucuccucccuccgcuccgacgacaccgccgucuacuucugcgcccgcgagaaccucgacaacuccggcaccuacuacuacuucuccggcugguucgaccccuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagcgcgucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgaggagaugaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61389 - RNA, 663 nt, Artificial Sequence
  derived and/or modified sequence opt2 from CDS (LC) w/o signal peptide as RNA from mRNA R3059, R3061, R4118, R4634, R4636, R4640
uccugggcccaguccgcccucacccagccccgcuccgucuccggcucccccggccaguccgucaccaucuccugcaccggcaccuccuccgacaucggcggcuacaacuucgucuccugguaccagcagcaccccggcaaggcccccaagcucaugaucuacgacgccaccaagcgccccuccggcguccccgaccgcuucuccggcuccaaguccggcaacaccgccucccucaccaucuccggccuccaggccgaggacgaggccgacuacuacugcugcuccuacgccggcgacuacacccccggcgucgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 61390 - RNA, 1371 nt, Artificial Sequence
  derived and/or modified sequence opt3 from CDS (HC) w/o signal peptide as RNA from mRNA R3059, R3061, R4118, R4634, R4636, R4640
caggugcaacugguccagagcggcgccgagguuaagaaacccggguccucugugaagguaucaugcaaagcuaguggagguaccuucaacagauacacagugaauugggucaggcaggcaccuggccaggggcucgaauggaugggaggcaucauuccaauauuugguacugccaacuaugcgcaacgguuccaggggcgccuuacgaucaccgcugacgagagcacauccacugccuacauggaacugucuucguugcgaucagaugacaccgcaguguauuuuugugcccgugagaauuuagauaacagcggaacauacuauuacuucaguggcugguuugacccguggggccaggggacccugguuacuguguccucugcuagcacaaagggacccuccgucuucccucuagcaccaucaaguaaaagcaccucugguggcacggccgcucucgggugccuggugaaggauuauuuucccgaaccuguaacuguuuccuggaacucaggagcccuuaccagcggcgugcacacauucccagcgguccugcagaguucugguuuguacucccucagcucgguggugacuguccccucuuccucacuggggacccaaacauacauuuguaauguuaaucauaagccuaguaacaccaaaguggacaagagaguagagccaaaaagcugcgauaagacgcacacuuguccgcccugcccugcaccagagcugcucggaggccccuccguguuuuuauucccuccaaaacccaaggacacacugaugaucucuaggaccccggaagucacuugugugguuguggaugucagccaugaggacccugaagugaaguuuaauugguauguagauggcguugaggugcacaacgccaaaacaaagccccgggaggaacaguacaauucaaccuaucgcgucgugaguguccuuacgguguugcaucaggacuggcugaacgggaaagaguacaagugcaaaguuuccaauaaggcucuaccagccccuauugagaaaaccaucagcaaggcaaagggacagcccagagaaccacaaguguauacacugcccccuucuagggaagagaugacuaaaaaccagguaucacucaccugucuugucaaggguuucuacccaagugauauagcuguggagugggaaagcaauggccagccggagaacaacuauaaaacaacucccccuguucuggacuccgacgggucguuuuucuuguacucuaagcucaccguggauaaaagccgguggcaacagggaaaugucuucuccugcucagugaugcacgaagcccugcacaaccauuacacacagaagaguuuaucucugagcccaggcaag

SEQ ID NO: 61391 - RNA, 663 nt, Artificial Sequence
  derived and/or modified sequence opt3 from CDS (LC) w/o signal peptide as RNA from mRNA R3059, R3061, R4118, R4634, R4636, R4640
agcugggcccaguccgcucugacccaacccagaucugugucaggcaguccugggcagagcgucacaaucuccugcacuggaacgucuucggacauugguggcuacaacuucguuucaugguaucagcagcacccagggaaggcaccgaaacucaugauauacgaugccaccaagaggcccagcggagugccugaccgguuuaguggcuccaaaucugguaauacagcgagccuuacuaucuccgggcugcaagcugaggaugaagccgacuauuacuguugcucauaugcaggagauuacaccccaggcguaguguucggcgggggaacaaaguugaccgucuuaggucagcccaaagccgcuccuagugugacucuguuuccacccagcucugaggaacuacaggcaaacaaggccacacucguuugucugauuuccgacuucuauccuggcgcugugaccgucgccuggaaggcggauucaagcccagugaaagcagggguagagacgacuaccccgaguaagcagucuaauaacaaauacgccgcuuccagcuaccuuucgcugacacccgaacaauggaagucucaucgcuccuauucaugccagguuacucacgagggaaguaccguggagaaaacagucgccccuaccgaauguagc

SEQ ID NO: 61392 - RNA, 1371 nt, Artificial Sequence
  derived and/or modified sequence opt4 from CDS (HC) w/o signal peptide as RNA from mRNA R3059, R3061, R4118, R4634, R4636, R4640
caggugcagcuggugcagagcggcgccgaggugaagaagcccggcagcagcgugaaggugagcugcaaggccagcggcggcaccuucaacagauacaccgugaacugggugagacaggcccccggccagggccuggaguggaugggcggcaucauccccaucuucggcaccgccaacuacgcccagagauuccagggcagacugaccaucaccgccgacgagagcaccagcaccgccuacauggagcugagcagccugagaagcgacgacaccgccguguacuucugcgccagagagaaccuggacaacagcggcaccuacuacuacuucagcggcugguucgaccccuggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagagaguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagaggagaugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61393 - RNA, 663 nt, Artificial Sequence
  derived and/or modified sequence opt4 from CDS (LC) w/o signal peptide as RNA from mRNA R3059, R3061, R4118, R4634, R4636, R4640
agcugggcccagagcgcccugacccagcccagaagcgugagcggcagccccggccagagcgugaccaucagcugcaccggcaccagcagcgacaucggcggcuacaacuucgugagcugguaccagcagcaccccggcaaggcccccaagcugaugaucuacgacgccaccaagagacccagcggcgugcccgacagauucagcggcagcaagagcggcaacaccgccagccugaccaucagcggccugcaggccgaggacgaggccgacuacuacugcugcagcuacgccggcgacuacacccccggcgugguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 61394 - RNA, 1371 nt, Artificial Sequence
  derived and/or modified sequence opt5 from CDS (HC) w/o signal peptide as RNA from mRNA R3059, R3061, R4118, R4634, R4636, R4640
caggugcaacugguccagagcggcgcugagguuaagaaacccggguccucugugaaggugagcugcaaggcuuccggaggcaccuucaacagauacacagucaauugggugcggcaggccccugggcagggacucgaauggaugggcgggaucauuccgaucuuuggaacggcgaacuaugcucaacgcuuccagggcagacugaccauuacagccgacgagucuaccagcacagccuacauggaacuuuccucucugcggagcgaugacaccgcuguuuauuuuugugcccgcgagaaucucgauaacuccggcacauacuauuacuucagcgggugguuugaccccuggggacagggcacccuggugacggucucuuccgcuagcaccaaagggccuucuguguucccccuugccccuuccagcaaaucuacauccggaggcaccgcggcccuggggugccucguuaaggauuauuuucccgaaccugugacagucagcuggaacuccggagcucugaccucuggcgugcacacguucccggccgugcugcagagcuccggccucuacagccugucuuccgucguuacagugcccagcucuagccuugggacccaaacauacaucuguaaugugaaucauaagccuuccaacaccaaagucgacaagagaguggagcccaaaucuugcgauaagacccacacauguccucccugcccggcuccugagcugcucggaggccccagcguuuuucuguucccucccaaacccaaggacacgcuuaugauuucccggaccccugaagugacaugugucgugguugaugugagccaugaggacccggaagucaaguuuaauugguauguggauggggucgaggugcacaacgccaaaaccaagccccgcgaggaacaguacaauucuacauauagaguuguguccguccugaccgugcuccaucaggacuggcugaacggaaaagaguacaagugcaaaguuagcaauaaggcgcugccugcccccaucgagaaaacgaucucuaaggcuaagggccagccucgggaaccccaaguguauacacucccgccuucccgcgaagagaugaccaaaaaccaggucagccugaccugucuugugaagggguucuaccccuccgauauugccguggagugggaaucuaauggacagccugagaacaacuauaaaacaacacccccuguucuggacagcgacggcuccuuuuuccucuacucuaagcugaccgucgauaaaagcagauggcaacagggcaauguguucuccugcagcgugaugcacgaagcccuucacaaccauuacacgcagaagucucugucccucagccccgggaag

SEQ ID NO: 61395 - RNA, 663 nt, Artificial Sequence
  derived and/or modified sequence opt5 from CDS (LC) w/o signal peptide as RNA from mRNA R3059, R3061, R4118, R4634, R4636, R4640
agcugggcccaguccgcucugacccaacccagaucugugagcggcuccccugggcagucugucacaaucagcugcacgggaaccuccucugacauuggcggguacaacuucguuagcugguaucagcagcacccgggaaaggcccccaaacucaugaucuacgaugcgacaaagcggccuuccggcgugcccgaccgcuuuagcgggucuaaauccggaaauaccgcuagccugacaauuucuggccuucaagccgaggaugaagccgacuauuacuguugcuccuaugcuggcgauuacaccccugggguggucuucggaggcgggacaaagcugaccgugcucggacagcccaaagccgcuccuagcguuacgcuguuuccgcccucuuccgaggaacuucaggccaacaaggcgacccuggugugucucaucagcgacuucuauccuggcgccgucacaguggcuuggaaggccgauuccucucccguuaaagcugggguggagaccacaaccccuagcaagcaguccaauaacaaauacgccgcgagcucuuaccugucccugacgcccgaacaauggaaaagccauagaucuuauagcugccaggucacacacgagggauccaccguggagaagacaguggccccgaccgaauguucu

SEQ ID NO: 61396 - RNA, 1371 nt, Artificial Sequence
  derived and/or modified sequence opt6 from CDS (HC) w/o signal peptide as RNA from mRNA R3059, R3061, R4118, R4634, R4636, R4640
caaguacaauuaguacaaucuggagccgaaguaaaaaaacccggaucaucuguuaaagugucauguaaagcauccgguggaacauucaacagauauacaguaaauuggguacgucaagccccaggucaaggacuagaauggaugggaggcauaauaccaauauuuggaacagcaaacuacgcacaaagauuccaaggaagacuaacaauaacagcagacgaaucaacaucaacagccuacauggaacuaagcucacuucgaagugacgacacagcaguauacuucugcgcaagagaaaacuuagauaacucagguacauacuacuacuuuucaggcugguucgauccauggggucaaggaaccuuaguaaccguauccagcgcaucaacuaaaggaccauccguauuuccacuagcaccaucuucaaaaucaacaagcggaggaacagcagcacuaggaugcuuaguaaaagauuauuuuccagaacccguaacaguaagcuggaacucaggagcacucacaucaggaguacauaccuucccagcaguacuacaaucuucaggcuuauauuccuuaucaucuguuguaacaguaccaucaucaucacuaggcacacaaacauacauaugcaauguaaaucauaaaccaucaaacacaaaaguagacaaaagaguagaaccaaaaucaugcgacaaaacacacacaugcccccccugccccgcccccgaacuacucggcggaccuucugucuuccuauucccaccaaaaccaaaagacacacuaaugauaaguagaaccccugaagucacaugcgucguaguagacguaucacaugaagacccugaagucaaauucaauugguacguggacggaguagaaguacacaacgcaaaaacaaaaccaagagaagaacaauauaauuccacauaccgaguuguaucaguccuaacaguuuuacaccaagacuggcuaaauggaaaagaauauaaaugcaaaguaucuaacaaagcauuaccagcaccaauagaaaaaacaauaucaaaagcaaaaggacaaccaagagaaccacaaguuuacacccucccaccaucaagagaagaaaugacaaaaaaccaaguaucauuaacaugccuuguuaaaggauuuuauccauccgauauagcaguugaaugggaaucaaacggucaaccagaaaacaacuacaaaacaaccccaccaguacuagauucagacggaucauucuuccuauacucaaaauuaacaguagauaaauccagauggcaacaaggaaauguuuucaguuguuccguaaugcacgaagcacuacacaaucacuauacacaaaaaucacuaucucuauccccaggaaaa

SEQ ID NO: 61397 - RNA, 663 nt, Artificial Sequence
  derived and/or modified sequence opt6 from CDS (LC) w/o signal peptide as RNA from mRNA R3059, R3061, R4118, R4634, R4636, R4640
ucaugggcacaaucagcauuaacacaaccacgaucaguaucaggaucaccaggacaaucaguaacaauaucauguacaggcacaucaucagacauaggaggauacaacuuuguaagcugguaccaacaacauccaggaaaagcaccaaaacuaaugauauacgacgccacaaaaagaccaucaggagucccagacagauucuccggaucaaaaucaggaaacaccgcaucacuaacaauuucaggauuacaagcagaagacgaagcagauuacuacugcugcagcuaugcaggagacuacacaccaggaguagucuucggaggaggaacaaaauuaacaguacuaggacaaccaaaagcagcaccaucaguaacacuauucccaccaucaagugaagaauuacaagcaaacaaagcaacacuaguaugccuaauaucagacuucuaccccggcgcaguaacaguagcauggaaagcagacucaucaccaguaaaagcaggaguagaaaccacaacaccaucaaaacaaucaaacaacaaauaugcagcaucaucauauuuaucucuaacaccagaacaauggaaaucacacagaucauauucaugccaaguaacacacgaaggaucaacaguagaaaaaacaguagcaccaacagaauguucc

SEQ ID NO: 61398 - RNA, 1371 nt, Artificial Sequence
  derived and/or modified sequence opt11 from CDS (HC) w/o signal peptide as RNA from mRNA R3059, R3061, R4118, R4634, R4636, R4640
cagguccaacucguccaaucaggagccgagguaaagaaacccggcucauccguaaaagucucaugcaaagcauccggcggcaccuucaaccgcuacaccgucaacuggguccgccaagccccaggccaaggacuagaauggaugggaggcaucauaccaaucuucggcaccgccaacuacgcacaacgcuuccaaggccgccucacuauaaccgcagacgagagcacaucgacugccuacauggagcucucaucccuccgcucugacgacaccgccgucuacuucugcgcaagagaaaaccucgacaacuccggcaccuacuacuacuucuccggcugguucgacccauggggccaaggcacccucguaaccguauccagcgccuccaccaaaggccccucuguauucccccucgccccauccucaaaauccaccuccggcggaaccgccgcacucggcugccuuguaaaagacuacuuccccgaaccagucacagucuccuggaacuccggcgcccucacuucaggaguccacaccuuccccgcaguccuccaauccagcggucucuacucccucuccucugucguaaccguacccucuucauccuuaggcacccaaacauacaucugcaacguaaaccacaagcccucuaacaccaaagucgacaaacgagucgaaccaaaaagcugcgacaagacccauaccugcccacccugccccgcacccgaacuccuaggcggacccuccguauuucucuucccacccaaacccaaagacacacucaugaucucccgcacccccgaaguaaccugcgucguaguagacgugucacacgaagaccccgaagucaaauucaacugguacgucgacggcgucgaaguccacaacgcaaagacaaaaccccgcgaagaacaauauaacucaacguaccgaguagucuccguccucaccguccuccaccaagacuggcuaaacggcaaagaguacaaaugcaaaguauccaacaaagcucuccccgcucccauagagaaaacaaucucaaaagccaaaggccaaccccgcgaaccacaaguauacacccugccacccucccgcgaagaaaugaccaaaaaccaagucucacuaacaugccuugucaaaggcuucuaccccuccgauauagcggucgaaugggaauccaacggccaacccgaaaacaacuacaaaaccaccccacccguccucgacucggacggauccuucuuucucuacuccaaacuaaccgucgacaaauccagauggcaacaaggaaacgucuucuccugcuccgucaugcacgaagcccuacauaaucacuacacccaaaaaucacuaucccucucccccggaaaa

SEQ ID NO: 61399 - RNA, 663 nt, Artificial Sequence
  derived and/or modified sequence opt11 from CDS (LC) w/o signal peptide as RNA from mRNA R3059, R3061, R4118, R4634, R4636, R4640
uccugggcccaauccgcccucacccaaccacgcuccgucuccggcucccccggccaaucagucacaaucuccugcacaggaaccuccuccgacaucggcggcuacaacuucgucuccugguaccaacaacaccccggcaaagcccccaaacucaugaucuacgacgccaccaaacgcccauccggcguccccgaccgcuucuccggcuccaaaucaggcaacacagccucccucaccaucuccggccuccaagccgaagacgaagccgacuacuacugcugcuccuacgcaggcgacuacacaccaggcgucgucuucggcggaggcaccaaacucaccguccucggccaacccaaagcagcccccuccgucacccuauucccccccucauccgaagaacuacaagccaacaaagccacccucgucugccucaucucagacuucuaccccggcgccguaaccguagccuggaaagccgacuccucccccgucaaagccggcgucgaaaccaccacccccuccaaacaauccaacaacaaauacgccgccucuuccuaccucucccucacccccgaacaauggaaaucccaccgauccuacucaugccaagucacccacgaagguuccaccguagaaaaaaccgucgcccccaccgaaugcuca

SEQ ID NO: 61400 - protein, 476 aa, Artificial Sequence [sequence omitted]

SEQ ID NO: 61401 - protein, 242 aa, Artificial Sequence [sequence omitted]

SEQ ID NO: 61402 - RNA, 1431 nt, Artificial Sequence
  CDS 1 (HC) as RNA from mRNA R3059, R3061, R4634
auggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaaguga

SEQ ID NO: 61403 - RNA, 729 nt, Artificial Sequence
  CDS 2 (LC) as RNA from mRNA R3059, R3061, R4634
augagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccuga

SEQ ID NO: 61404 - RNA, 2839 nt, Artificial Sequence
  CDS 1-IRES-CDS 2 as RNA from mRNA R3059, R3061, R4634
auggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccuga

SEQ ID NO: 61405 - RNA, 3031 nt, Artificial Sequence
  R3059
gggagaaagcuuaccauggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61406 - RNA, 3221 nt, Artificial Sequence
  R3061
ggggcgcugccuacggagguggcagccaucuccuucucggcaucaagcuuaccauggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61407 - RNA, 3241 nt, Artificial Sequence
  R4634
gggucccgcagucggcguccagcggcucugcuuguucgugugugugucguugcaggccuuauucaagcuuaccauggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61408 - protein, 476 aa, Artificial Sequence [sequence omitted]

SEQ ID NO: 61409 - RNA, 1431 nt, Artificial Sequence; identical to SEQ ID NO: 61402
  CDS (HC) as RNA from mRNA R4116, R4635

SEQ ID NO: 61410 - RNA, 1635 nt, Artificial Sequence
  R4116
gggagaaagcuuaccauggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61411 - RNA, 1833 nt, Artificial Sequence
  R4635
gggucccgcagucggcguccagcggcucugcuuguucgugugugugucguugcaggccuuauucaagcuuaccauggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61412 - protein, 242 aa, Artificial Sequence [sequence omitted]

SEQ ID NO: 61413 - RNA, 729 nt, Artificial Sequence; identical to SEQ ID NO: 61403
  CDS (LC) as RNA from mRNA R4118, R4636

SEQ ID NO: 61414 - RNA, 933 nt, Artificial Sequence
  R4118
gggagaaagcuuaccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61415 - RNA, 1131 nt, Artificial Sequence
  R4636
gggucccgcagucggcguccagcggcucugcuuguucgugugugugucguugcaggccuuauucaagcuuaccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61416 - RNA, 2223 nt, Artificial Sequence
  CDS (HC)-F2A-CDS (LC) as RNA from mRNA R4640
auggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaaggugaagcagacacucaauuucgaccuucugaaguuggcuggagauguugagucuaacccaggccccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccuga

SEQ ID NO: 61417 - RNA, 2625 nt, Artificial Sequence
  R4640
gggucccgcagucggcguccagcggcucugcuuguucgugugugugucguugcaggccuuauucaagcuuaccauggacuggaccuggcgcuuccuguucguggucgccgccgcgaccggcgugcagagccaggugcagcucguccaguccggggccgaggugaagaagcccggcagcuccgugaaggucagcugcaaggccuccgggggcacguucaaccgguacaccgugaacugggugcgccaggccccggggcagggccuggaguggaugggcgggaucauccccaucuucggcaccgccaacuacgcgcagcgguuccaggggcgccugaccaucacggccgacgagagcaccuccaccgccuacauggagcucagcucccugcggagcgacgacaccgccgucuacuucugcgcgcgcgagaaccuggacaacuccggcacguacuacuacuucagcgggugguucgaccccuggggccagggcacccucgugaccguguccagcgccuccaccaaggggcccagcgucuucccgcuggcccccuccagcaaguccacgagcggcgggaccgccgcccugggcugccucgugaaggacuacuuccccgagcccgugaccgucagcuggaacuccggcgcgcugaccagcggggugcacacguucccggccgugcugcaguccagcggccucuacucccugagcuccgucgugaccgugcccagcuccagccuggggacccagaccuacaucugcaacgucaaccacaagcccuccaacacgaagguggacaagcggguggagcccaagagcugcgacaagacccacaccugcccgcccugccccgccccggagcuccugggcgggccguccgucuuccuguucccucccaagcccaaggacacccucaugaucagccgcacgccggaggugaccugcgucgugguggacgugucccacgaggaccccgaggugaaguucaacugguacguggacggcgucgaggugcacaacgccaagaccaagccccgggaggagcaguacaacagcaccuaccgcguggucuccgugcugacggugcugcaccaggacuggcucaacggcaaggaguacaagugcaaggucagcaacaaggcccugcccgcgccgaucgagaagaccaucuccaaggccaaggggcagccccgggagccccagguguacacccugcccccgagccgcgaggagaugaccaagaaccaggugagccucacgugccuggucaagggcuucuaccccuccgacaucgccguggagugggagagcaacgggcagcccgagaacaacuacaagaccaccccgcccgugcuggacuccgacggcagcuucuuccucuacuccaagcugaccgucgacaagagccgguggcagcaggggaacguguucuccugcagcgugaugcacgaggcccugcacaaccacuacacgcagaagucccucagccugucccccggcaaggugaagcagacacucaauuucgaccuucugaaguuggcuggagauguugagucuaacccaggccccaugagcgugcccaccauggccugggcccugcuccugcugucccuccugacccagggcacggggagcugggcgcaguccgcccugacccagccgcgcagcgucuccggcagccccgggcaguccgugaccaucagcugcaccggcacguccagcgacaucgggggcuacaacuucguguccugguaccagcagcaccccggcaaggcccccaagcucaugaucuacgacgccaccaagcggccgagcgggguccccgaccgcuucuccggcagcaaguccgggaacaccgccagccugaccaucuccggccugcaggcggaggacgaggccgacuacuacugcugcagcuacgccggggacuacacgcccggcgugguguucggcgggggcaccaagcucaccguccuggggcagccgaaggccgcgccguccgugacccuguucccucccagcagcgaggagcuccaggccaacaaggccacgcuggugugccugaucuccgacuucuaccccggcgccgucaccguggccuggaaggcggacagcuccccggugaaggccggcgucgagaccaccacgcccagcaagcaguccaacaacaaguacgccgccagcuccuaccucagccugacccccgagcaguggaagucccaccggagcuacuccugccaggugacccacgaggggagcaccguggagaagacggucgcccccaccgagugcuccugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61418 - protein, 457 aa, Artificial Sequence
  Protein (HC) w/o signal peptide encoded by mRNA R5230
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 61419 - RNA, 1371 nt, Artificial Sequence
  CDS (HC) w/o signal peptide encoded by mRNA R5230
cagguccagcucgugcagagcggggccgaggugaagaagcccggcuccagcgucaagguguccugcaaggcgagcgggggcaccuucaaccgcuacacggugaacuggguccggcaggccccggggcagggccuggaguggaugggcgggaucauccccaucuucggcaccgccaacuacgcccagcgcuuccaggggcggcugaccaucaccgccgacgaguccacgagcaccgcguacauggagcucuccagccugcgcuccgacgacaccgccguguacuucugcgcccgggagaaccuggacaacagcggcaccuacuacuacuucuccgggugguucgaccccuggggccagggcacgcucgugaccgucagcuccgccaagaccaccgcgcccagcguguacccgcuggcccccgugugcggggacacgaccggcuccagcgucacccuggggugccucgugaagggcuacuuccccgagcccgugacccugacguggaacuccggcagccugagcuccgggguccacaccuucccggccgugcuccagagcgaccuguacacccuguccagcuccgugaccgucacgagcuccaccuggcccagccaguccaucacgugcaacguggcccaccccgccagcuccaccaagguggacaagaagaucgagccccgcggcccgacgaucaagcccugcccgcccugcaagugcccggcgcccaaccuccugggcgggcccagcgucuucaucuucccgccgaagaucaaggacgugcugaugaucucccucagccccaucgugaccugcgugguggucgacguguccgaggacgaccccgacgugcagaucagcugguucgucaacaacguggaggugcacaccgcccagacccagacgcaccgggaggacuacaacuccacccugcgcgucgugagcgcccugcccauccagcaccaggacuggauguccgggaaggaguucaagugcaaggugaacaacaaggaccucccggcccccaucgagcggaccaucagcaagccgaagggcagcguccgcgcgccccagguguacgugcugccgccgcccgaggaggagaugaccaagaagcaggucacgcugaccugcauggugaccgacuucaugccggaggacaucuacguggaguggaccaacaacggcaagacggagcucaacuacaagaacaccgagcccguccuggacuccgacgggagcuacuucauguacuccaagcugcggguggagaagaagaacuggguggagcgcaacagcuacuccugcagcgucgugcacgagggccuccacaaccaccacaccaccaaguccuucagccggacccccgggaag

SEQ ID NO: 61420 - RNA, 1371 nt, Artificial Sequence
  derived and/or modified sequence opt2 from CDS (HC) w/o signal peptide encoded by mRNA R5230
cagguccagcucguccaguccggcgccgaggucaagaagcccggcuccuccgucaaggucuccugcaaggccuccggcggcaccuucaaccgcuacaccgucaacuggguccgccaggcccccggccagggccucgaguggaugggcggcaucauccccaucuucggcaccgccaacuacgcccagcgcuuccagggccgccucaccaucaccgccgacgaguccaccuccaccgccuacauggagcucuccucccuccgcuccgacgacaccgccgucuacuucugcgcccgcgagaaccucgacaacuccggcaccuacuacuacuucuccggcugguucgaccccuggggccagggcacccucgucaccgucuccuccgccaagaccaccgcccccuccgucuacccccucgcccccgucugcggcgacaccaccggcuccuccgucacccucggcugccucgucaagggcuacuuccccgagcccgucacccucaccuggaacuccggcucccucuccuccggcguccacaccuuccccgccguccuccaguccgaccucuacacccucuccuccuccgucaccgucaccuccuccaccuggcccucccaguccaucaccugcaacgucgcccaccccgccuccuccaccaaggucgacaagaagaucgagccccgcggccccaccaucaagcccugcccccccugcaagugccccgcccccaaccuccucggcggccccuccgucuucaucuucccccccaagaucaaggacguccucaugaucucccucucccccaucgucaccugcgucgucgucgacgucuccgaggacgaccccgacguccagaucuccugguucgucaacaacgucgagguccacaccgcccagacccagacccaccgcgaggacuacaacuccacccuccgcgucgucuccgcccuccccauccagcaccaggacuggauguccggcaaggaguucaagugcaaggucaacaacaaggaccuccccgcccccaucgagcgcaccaucuccaagcccaagggcuccguccgcgccccccaggucuacguccuccccccccccgaggaggagaugaccaagaagcaggucacccucaccugcauggucaccgacuucaugcccgaggacaucuacgucgaguggaccaacaacggcaagaccgagcucaacuacaagaacaccgagcccguccucgacuccgacggcuccuacuucauguacuccaagcuccgcgucgagaagaagaacugggucgagcgcaacuccuacuccugcuccgucguccacgagggccuccacaaccaccacaccaccaaguccuucucccgcacccccggcaag

SEQ ID NO: 61421 - RNA, 1371 nt, Artificial Sequence
  derived and/or modified sequence opt3 from CDS (HC) w/o signal peptide encoded by mRNA R5230
caggugcaacugguccagagcggcgccgagguuaagaaacccggguccucugugaagguaucaugcaaagcuaguggagguaccuucaacagauacacagugaauugggucaggcaggcaccuggccaggggcucgaauggaugggaggcaucauuccaauauuugguacugccaacuaugcgcaacgguuccaggggcgccuuacgaucaccgcugacgagagcacauccacugccuacauggaacugucuucguugcgaucagaugacaccgcaguguauuuuugugcccgugagaauuuagauaacagcggaacauacuauuacuucaguggcugguuugacccguggggccaggggacccugguuacuguguccucugcuaagacaaccgcacccagcgucuauccucuagccccagugugcggagauacgacugguuccucaguaacccucggcugucugguuaaaggguacuuccccgaaccugugacacuuacuuggaauaguggaagccugucuuccggcguccacaccuuuccagcuguguugcagucagaccucuacacacugagcaguucugugaccgucacguccagcacuuggcccucgcaaucuauuacaugcaacguugcccauccugcguccucaaccaagguggauaagaaaaucgagccaagagguccgacuauuaagcccuguccuccaugcaaaugucccgcaccuaaucugcucgggggaccaaguguauucaucuuucccccgaagauaaaagacguguuaaugaucagccuguccccuauugucacaugcgugguuguggaugucucugaggacgaucccgacgugcagaucagcugguucguaaacaauguugaagugcacaccgcccagacgcagacccauagggaggauuauaacucaacacuucgggucgugagugcuuugccaauucaacaccaggacuggauguccggcaaggaauuuaaguguaaagucaauaacaaggaccugccugcccccaucgagcgcacuauaagcaaaccaaagggcucugugagagcaccccagguuuacgugcuaccuccaccggaggaagagaugaccaaaaagcaaguaacacucacuugcauggucaccgauuucaugcccgaagacauuuauguggaguggacaaauaacgggaaaaccgaacugaauuacaagaacacugagccuguucuugauucagacggaaguuauuuuauguacagcaagcugaggguggagaaaaagaacugggucgaacggaauagcuauucuuguucggugguacaugaggguuugcacaaccaccauacgacaaaauccuucucccgcaccccaggcaag

SEQ ID NO: 61422 - RNA, 1371 nt, Artificial Sequence
  derived and/or modified sequence opt4 from CDS (HC) w/o signal peptide encoded by mRNA R5230
caggugcagcuggugcagagcggcgccgaggugaagaagcccggcagcagcgugaaggugagcugcaaggccagcggcggcaccuucaacagauacaccgugaacugggugagacaggcccccggccagggccuggaguggaugggcggcaucauccccaucuucggcaccgccaacuacgcccagagauuccagggcagacugaccaucaccgccgacgagagcaccagcaccgccuacauggagcugagcagccugagaagcgacgacaccgccguguacuucugcgccagagagaaccuggacaacagcggcaccuacuacuacuucagcggcugguucgaccccuggggccagggcacccuggugaccgugagcagcgccaagaccaccgcccccagcguguacccccuggcccccgugugcggcgacaccaccggcagcagcgugacccugggcugccuggugaagggcuacuuccccgagcccgugacccugaccuggaacagcggcagccugagcagcggcgugcacaccuuccccgccgugcugcagagcgaccuguacacccugagcagcagcgugaccgugaccagcagcaccuggcccagccagagcaucaccugcaacguggcccaccccgccagcagcaccaagguggacaagaagaucgagcccagaggccccaccaucaagcccugcccccccugcaagugccccgcccccaaccugcugggcggccccagcguguucaucuucccccccaagaucaaggacgugcugaugaucagccugagccccaucgugaccugcguggugguggacgugagcgaggacgaccccgacgugcagaucagcugguucgugaacaacguggaggugcacaccgcccagacccagacccacagagaggacuacaacagcacccugagaguggugagcgcccugcccauccagcaccaggacuggaugagcggcaaggaguucaagugcaaggugaacaacaaggaccugcccgcccccaucgagagaaccaucagcaagcccaagggcagcgugagagccccccagguguacgugcugcccccccccgaggaggagaugaccaagaagcaggugacccugaccugcauggugaccgacuucaugcccgaggacaucuacguggaguggaccaacaacggcaagaccgagcugaacuacaagaacaccgagcccgugcuggacagcgacggcagcuacuucauguacagcaagcugagaguggagaagaagaacuggguggagagaaacagcuacagcugcagcguggugcacgagggccugcacaaccaccacaccaccaagagcuucagcagaacccccggcaag

SEQ ID NO: 61423 - RNA, 1371 nt, Artificial Sequence
  derived and/or modified sequence opt5 from CDS (HC) w/o signal peptide encoded by mRNA R5230
caggugcaacugguccagagcggcgccgagguuaagaaacccggguccucugugaaggugagcugcaaagcuagcggaggcaccuucaacagauacacagucaauugggugcggcaggccccugggcagggacucgaauggaugggcgggaucauuccgaucuuuggaacggcgaacuaugcucaacgcuuccagggcagacugaccauuacagccgacgagucuaccagcacagccuacauggaacuuuccucucugcggagcgaugacaccgcuguuuauuuuugugcccgcgagaaucucgauaacuccggcacauacuauuacuucagcgggugguuugaccccuggggacagggcacccuggugacggucucuuccgcuaagaccacagccccuagcguguauccccuugcgccuguuugcggggauaccacaggaucuuccgugacccugggcugucucgucaaaggguacuuccccgaaccugugacgcugacauggaauagcggaucucuguccagcggcgugcacaccuuuccggccguccuccaguccgaccuguacacacuuucuagcuccguuaccgugaccagcucuacauggcccucccaaagcaucacgugcaacguggcucauccugccucuagcaccaaggucgauaagaaaauugagcccagaggcccuacaaucaagcccuguccgccuugcaaaugucccgcuccuaaucugcucgggggacccuccguguucaucuuucccccuaagauuaaagacguucugaugaucucucuuagcccgauugugaccugcgucgugguugauguguccgaggacgaucccgacguccagaucagcugguucgugaacaaugucgaagugcacacagcccagacccagacgcaucgggaggauuauaacucuacacugcgcguuguguccgcgcucccuauucaacaccaggacuggaugagcggcaaggaauuuaaguguaaagucaauaacaaggaccugcccgccccuaucgagagaaccauuucuaaacccaagggguccgugcgggcuccgcagguuuacgugcugccucccccugaggaagagaugaccaaaaagcaagucacacugaccugcauggugacagauuucaugcccgaagacaucuauguggaguggacgaauaacggaaaaaccgaacucaauuacaagaacacagagccuguucuugauagcgacggcuccuauuuuauguacucuaagcugcgcgucgagaaaaagaacuggguggaaagaaauagcuauuccuguucugugguccaugaggggcuccacaaccaccauaccacaaaauccuucucccggacccccggaaag

SEQ ID NO: 61424 - RNA, 1371 nt, Artificial Sequence
  derived and/or modified sequence opt6 from CDS (HC) w/o signal peptide encoded by mRNA R5230
caaguacaauuaguucaaucaggugcagaaguaaaaaaaccagguuccuccguuaaaguaucgugcaaagcuaguggagguacauucaacagauacacaguaaacugggucagacaagcaccuggacaaggacuagaauggaugggaggaauaauacccauauuuggaacugcuaauuacgcacaaagauuccaaggaagauuaaccaucacagcagaugaaucuacaucuacagccuacauggaacuuagcagccuaagaucagacgauacagcuguauacuuuugcgcacgugaaaaccuagauaauucaggaacauauuacuauuucuccggaugguuugacccauggggccaagguacauuaguuacuguaucauccgcaaaaacaacagcuccuucaguauacccauuagcucccguaugcggagauacaaccggauccaguguaacacuaggaugccuagucaaaggauacuucccagaaccaguaacucuaaccuggaacuccggaucuuuauccuccggaguucacacauucccagcaguucuacaaucagauuuauauacauuauccucaucagugacaguaacaucuaguacauggccaucacaaucaauaacaugcaacgucgcacacccagcaucaucaacaaaaguagauaaaaaaauagaaccacgaggaccaacaauuaaaccaugcccaccauguaaaugccccgccccaaaucuauuaggagguccaucaguauucauauucccuccaaaaauaaaagacguccuuaugauaucauuaaguccaauaguaacaugcguaguaguagauguuucagaagaugacccagacguacaaauaucaugguucgucaacaauguagaaguucauacagcacaaacacaaacucaccgagaagauuacaacagcacacuaagagucguaucagcacuuccaauacaacaccaagauuggauguccggaaaagaauucaaaugcaaagucaacaacaaagaucuaccagcaccaaucgaaagaacaauaucaaaaccaaaaggauccguacgugcuccacaaguuuauguacuaccaccaccagaagaagaaaugaccaaaaaacaagucacacuuacauguaugguaacagacuucaugcccgaagacauauauguagaauggacaaauaacggcaaaacugaauuaaacuauaaaaacacagaaccagucuuagacucagacggaucauauuucauguauucaaaacuaagaguagaaaaaaaaaauugggucgaaagaaacucauacucauguucaguaguacaugaaggccuucacaaucaucauacaacaaaaagcuucucaagaacuccaggaaaa

SEQ ID NO: 61425 - RNA, 1371 nt, Artificial Sequence
  derived and/or modified sequence opt11 from CDS (HC) w/o signal peptide encoded by mRNA R5230
caaguacagcucguacaaucaggcgccgaagucaagaaacccggcagcuccgucaaagucuccugcaaagccucuggagguacauucaaccgauacacagucaacuggguccgacaagcccccggccaaggccucgaauggaugggcggcaucauccccaucuucggaaccgcaaacuacgcccaacgauuccaaggcagacuuaccaucaccgcagacgaauccaccuccaccgcuuacauggagcuauccucccuacgcuccgacgacaccgccguuuacuucugcgcccgcgagaaccucgacaacucaggcaccuacuacuacuucuccggaugguucgaccccuggggacaaggcacccuagucaccgucagcagcgccaaaaccaccgccccaucggucuacccacuagcccccgucugcggcgacaccaccggauccagcguaacccucggcugccucgucaaaggcuacuuccccgaacccgucacacuaacauggaacucuggaucacuauccuccggaguccacaccuuuccagccguacuccaauccgaccucuauacccuaucaucguccguaaccgucaccagcuccaccuggccaucccaauccauaaccugcaacgucgcacaccccgcauccucaaccaaggucgacaagaaaaucgaaccacgcggcccaacaaucaaacccugcccacccugcaaaugccccgcccccaaccucuuaggaggccccuccgucuucaucuucccacccaaaauaaaagacguucuaaugauaucccucagccccaucgucacaugcgugguagucgacgucuccgaagacgaccccgauguacaaauauccugguucguaaacaacgucgaaguccacaccgcccaaacccaaacccaccgugaggauuacaacuccacccugcgagucguauccgcucucccaauacaacaccaagacuggauguccggaaaagaguucaaaugcaaagucaacaacaaagaccuccccgcccccauagaacgcaccaucuccaaaccaaaaggauccguccgugccccacaagucuacguccuacccccacccgaagaagaaaugacaaagaaacagguaacccuaaccugcaugguaaccgacuucaugcccgaagacaucuacgucgaauggaccaacaacggaaaaacugaacucaauuacaaaaacacggaacccguacucgacuccgacggcuccuacuucauguacuccaaacuccgcguagaaaagaaaaacugggucgaacgcaacuccuacucuugcagcgucguacacgaaggcuuacacaaccaccacacgaccaaaucauucuccagaaccccaggcaaa

SEQ ID NO: 61426 - protein, 476 aa, Artificial Sequence
  Protein (HC) encoded by mRNA R5230
MKCSWVIFFLMAVVTGVNSQVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 61427 - RNA, 1431 nt, Artificial Sequence
  CDS (HC) encoded by mRNA R5230
augaagugcagcugggugaucuucuuccugauggccgucgugaccggcgugaacucccagguccagcucgugcagagcggggccgaggugaagaagcccggcuccagcgucaagguguccugcaaggcgagcgggggcaccuucaaccgcuacacggugaacuggguccggcaggccccggggcagggccuggaguggaugggcgggaucauccccaucuucggcaccgccaacuacgcccagcgcuuccaggggcggcugaccaucaccgccgacgaguccacgagcaccgcguacauggagcucuccagccugcgcuccgacgacaccgccguguacuucugcgcccgggagaaccuggacaacagcggcaccuacuacuacuucuccgggugguucgaccccuggggccagggcacgcucgugaccgucagcuccgccaagaccaccgcgcccagcguguacccgcuggcccccgugugcggggacacgaccggcuccagcgucacccuggggugccucgugaagggcuacuuccccgagcccgugacccugacguggaacuccggcagccugagcuccgggguccacaccuucccggccgugcuccagagcgaccuguacacccuguccagcuccgugaccgucacgagcuccaccuggcccagccaguccaucacgugcaacguggcccaccccgccagcuccaccaagguggacaagaagaucgagccccgcggcccgacgaucaagcccugcccgcccugcaagugcccggcgcccaaccuccugggcgggcccagcgucuucaucuucccgccgaagaucaaggacgugcugaugaucucccucagccccaucgugaccugcgugguggucgacguguccgaggacgaccccgacgugcagaucagcugguucgucaacaacguggaggugcacaccgcccagacccagacgcaccgggaggacuacaacuccacccugcgcgucgugagcgcccugcccauccagcaccaggacuggauguccgggaaggaguucaagugcaaggugaacaacaaggaccucccggcccccaucgagcggaccaucagcaagccgaagggcagcguccgcgcgccccagguguacgugcugccgccgcccgaggaggagaugaccaagaagcaggucacgcugaccugcauggugaccgacuucaugccggaggacaucuacguggaguggaccaacaacggcaagacggagcucaacuacaagaacaccgagcccguccuggacuccgacgggagcuacuucauguacuccaagcugcggguggagaagaagaacuggguggagcgcaacagcuacuccugcagcgucgugcacgagggccuccacaaccaccacaccaccaaguccuucagccggacccccgggaaguga

SEQ ID NO: 61428 - RNA, 1833 nt, Artificial Sequence
  R5230
gggucccgcagucggcguccagcggcucugcuuguucgugugugugucguugcaggccuuauucaagcuuaccaugaagugcagcugggugaucuucuuccugauggccgucgugaccggcgugaacucccagguccagcucgugcagagcggggccgaggugaagaagcccggcuccagcgucaagguguccugcaaggcgagcgggggcaccuucaaccgcuacacggugaacuggguccggcaggccccggggcagggccuggaguggaugggcgggaucauccccaucuucggcaccgccaacuacgcccagcgcuuccaggggcggcugaccaucaccgccgacgaguccacgagcaccgcguacauggagcucuccagccugcgcuccgacgacaccgccguguacuucugcgcccgggagaaccuggacaacagcggcaccuacuacuacuucuccgggugguucgaccccuggggccagggcacgcucgugaccgucagcuccgccaagaccaccgcgcccagcguguacccgcuggcccccgugugcggggacacgaccggcuccagcgucacccuggggugccucgugaagggcuacuuccccgagcccgugacccugacguggaacuccggcagccugagcuccgggguccacaccuucccggccgugcuccagagcgaccuguacacccuguccagcuccgugaccgucacgagcuccaccuggcccagccaguccaucacgugcaacguggcccaccccgccagcuccaccaagguggacaagaagaucgagccccgcggcccgacgaucaagcccugcccgcccugcaagugcccggcgcccaaccuccugggcgggcccagcgucuucaucuucccgccgaagaucaaggacgugcugaugaucucccucagccccaucgugaccugcgugguggucgacguguccgaggacgaccccgacgugcagaucagcugguucgucaacaacguggaggugcacaccgcccagacccagacgcaccgggaggacuacaacuccacccugcgcgucgugagcgcccugcccauccagcaccaggacuggauguccgggaaggaguucaagugcaaggugaacaacaaggaccucccggcccccaucgagcggaccaucagcaagccgaagggcagcguccgcgcgccccagguguacgugcugccgccgcccgaggaggagaugaccaagaagcaggucacgcugaccugcauggugaccgacuucaugccggaggacaucuacguggaguggaccaacaacggcaagacggagcucaacuacaagaacaccgagcccguccuggacuccgacgggagcuacuucauguacuccaagcugcggguggagaagaagaacuggguggagcgcaacagcuacuccugcagcgucgugcacgagggccuccacaaccaccacaccaccaaguccuucagccggacccccgggaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61429 - protein, 217 aa, Artificial Sequence
  Protein (LC) w/o signal peptide encoded by mRNA R5231
QSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKSTPTLTVFPPSSEELKENKATLVCLISNFSPSGVTVAWKANGTPITQGVDTSNPTKEGNKFMASSFLHLTSDQWRSHNSFTCQVTHEGDTVEKSLSPAECL

SEQ ID NO: 61430 - RNA, 651 nt, Artificial Sequence
  CDS (LC) w/o signal peptide encoded by mRNA R5231
caguccgcccugacccagccccgcagcguguccgggagcccgggccaguccgucaccaucagcugcacggggaccuccagcgacaucggcggguacaacuucguguccugguaccagcagcaccccggcaaggcccccaagcugaugaucuacgacgccaccaagcggcccagcggcgugccggaccgcuucuccgggagcaaguccggcaacaccgccagccucacgaucuccgggcugcaggcggaggacgaggccgacuacuacugcugcagcuacgccggcgacuacacccccggggucguguucggcggcgggaccaagcugaccgugcucggccagcccaagagcacgcccacccugaccgucuucccgcccuccagcgaggagcugaaggagaacaaggccacccucgugugccugaucuccaacuucagccccuccggggugacggucgcguggaaggccaacggcacccccaucacccagggcguggacaccagcaacccgacgaaggaggggaacaaguucauggccuccagcuuccugcaccucaccuccgaccaguggcggagccacaacuccuucacgugccaggugacccacgagggcgacacggucgagaagagccugucccccgccgagugccug

SEQ ID NO: 61431 - RNA, 651 nt, Artificial Sequence
  derived and/or modified sequence opt2 from CDS (LC) w/o signal peptide encoded by mRNA R5231
caguccgcccucacccagccccgcuccgucuccggcucccccggccaguccgucaccaucuccugcaccggcaccuccuccgacaucggcggcuacaacuucgucuccugguaccagcagcaccccggcaaggcccccaagcucaugaucuacgacgccaccaagcgccccuccggcguccccgaccgcuucuccggcuccaaguccggcaacaccgccucccucaccaucuccggccuccaggccgaggacgaggccgacuacuacugcugcuccuacgccggcgacuacacccccggcgucgucuucggcggcggcaccaagcucaccguccucggccagcccaaguccacccccacccucaccgucuucccccccuccuccgaggagcucaaggagaacaaggccacccucgucugccucaucuccaacuucucccccuccggcgucaccgucgccuggaaggccaacggcacccccaucacccagggcgucgacaccuccaaccccaccaaggagggcaacaaguucauggccuccuccuuccuccaccucaccuccgaccaguggcgcucccacaacuccuucaccugccaggucacccacgagggcgacaccgucgagaagucccucucccccgccgagugccuc

SEQ ID NO: 61432 - RNA, 651 nt, Artificial Sequence
  derived and/or modified sequence opt3 from CDS (LC) w/o signal peptide encoded by mRNA R5231
cagagcgcccugacccaacccagauccgugucuggcucaccugggcagagugucacaaucagcugcacuggaacguccucugacauugguggcuacaacuucguuucgugguaucagcagcacccagggaaggcuccgaaacucaugauauacgaugcaaccaagaggcccucaggagugccugaccgguuuagcggcaguaaauccgguaauacagccucucuuacuaucagcgggcugcaagcggaggaugaagcugacuauuacuguugcuccuaugccggagauuacaccccaggcguaguguucggcgggggaacaaaguugaccgucuuaggucagcccaaaucaacuccuacacugaccguguuuccacccaguagcgaggaacuaaaggagaacaaggcaacgcucguuugucugauuucuaauuucuccccuucaggcgugacugucgccuggaaagcuaacgggaccccaaucacacagggaguggacacuagcaauccgaccaaggaaggcaacaaauuuauggcaaguucuuuccuucaucugacauccgaucaguggcgcagccacaauucguuuaccugccaaguaacgcaugagggugacacuguugagaagucuuugucccccgccgaaugucuc

SEQ ID NO: 61433 - RNA, 651 nt, Artificial Sequence
  derived and/or modified sequence opt4 from CDS (LC) w/o signal peptide encoded by mRNA R5231
cagagcgcccugacccagcccagaagcgugagcggcagccccggccagagcgugaccaucagcugcaccggcaccagcagcgacaucggcggcuacaacuucgugagcugguaccagcagcaccccggcaaggcccccaagcugaugaucuacgacgccaccaagagacccagcggcgugcccgacagauucagcggcagcaagagcggcaacaccgccagccugaccaucagcggccugcaggccgaggacgaggccgacuacuacugcugcagcuacgccggcgacuacacccccggcgugguguucggcggcggcaccaagcugaccgugcugggccagcccaagagcacccccacccugaccguguucccccccagcagcgaggagcugaaggagaacaaggccacccuggugugccugaucagcaacuucagccccagcggcgugaccguggccuggaaggccaacggcacccccaucacccagggcguggacaccagcaaccccaccaaggagggcaacaaguucauggccagcagcuuccugcaccugaccagcgaccaguggagaagccacaacagcuucaccugccaggugacccacgagggcgacaccguggagaagagccugagccccgccgagugccug

SEQ ID NO: 61434 - RNA, 651 nt, Artificial Sequence
  derived and/or modified sequence opt5 from CDS (LC) w/o signal peptide encoded by mRNA R5231
cagagcgcccugacccaacccagauccgugucuggcagcccugggcaguccgucacaaucucuugcacgggaaccagcuccgacauuggcggguacaacuucguuucuugguaucagcagcacccgggaaaggcucccaaacucaugaucuacgaugccacaaagcggccuagcggcgugcccgaccgcuuuuccgggagcaaaucuggaaauaccgcgucccugacaauuagcggccuucaagcugaggaugaagccgacuauuacuguugcucuuaugccggcgauuacaccccugggguggucuucggaggcgggacaaagcugaccgugcucggacagcccaaauccacgccuacccugacaguuuuuccgcccagcucugaggaacuuaaggagaacaaggcuacccuggugugucucaucuccaauuucagcccuuccggcgucacaguggccuggaaagcuaacgggacccccauuacgcagggaguugacacaucuaauccuaccaaggaaggcaacaaauuuauggccagcuccuuccugcaucugacaagcgaucaguggagaucucacaauuccuuuaccugccaagugacccaugagggcgacacagucgaaaagagccucucucccgcggagugucug

SEQ ID NO: 61435 - RNA, 651 nt, Artificial Sequence
  derived and/or modified sequence opt6 from CDS (LC) w/o signal peptide encoded by mRNA R5231
caaucagcacuaacacaaccaagaucaguaucaggaucaccaggacaauccguuacaauaucaugcacaggaacaucaucagacauaggaggauacaacuucguaucaugguaccaacaacacccaggaaaagcaccaaaauuaaugaucuacgacgcaaccaaaagaccaucaggaguaccagacagauuuuccggaucaaaaucaggaaacacagcaucacuaacaauauccggacuacaagcagaagacgaagcagacuauuacugcugcucauacgcaggagacuacaccccaggaguaguauucggaggaggcacaaaacuaacaguacuaggacaaccaaaaucuacuccaacccuaacaguauucccaccaucuuccgaagaacuaaaagaaaauaaagcaacauuaguaugcuuaaucucaaacuucucaccaucuggaguaacaguagcauggaaagcaaacggaaccccaauaacacaaggaguagacacauccaacccaacaaaagaaggaaacaaauucauggcaucaucauuccuacaccuaacaucagaccaauggagaucacacaacucauucacaugccaaguaacacacgaaggcgacacaguagaaaaaucauuaucaccagcagaaugccua

SEQ ID NO: 61436 - RNA, 651 nt, Artificial Sequence
  derived and/or modified sequence opt11 from CDS (LC) w/o signal peptide encoded by mRNA R5231
caauccgcccucacccaaccccgcuccgucuccggcucacccggacaauccguaaccaucuccugcaccggaaccuccuccgacaucggcggauacaacuucgucuccugguaccaacaacaccccggcaaagcccccaaacucaugaucuacgacgccaccaaacgccccuccggcguccccgaccgauucuccggcucaaaauccggcaacaccgccucacuaaccaucuccggccuccaagcagaagacgaagccgacuauuacugcugcuccuacgccggcgacuacacccccggaguagucuucggaggcggcaccaaacucacagucuuaggccaacccaaaucaacccccacccucaccgucuucccccccuccuccgaagaacucaaagaaaacaaagccacccucgucugccucaucuccaacuucucccccuccggcgucacagucgccuggaaagcaaacgguacacccauaacccaaggcgucgacaccuccaaccccaccaaagaaggcaacaaauucauggccuccuccuuccuccaccucaccuccgaccaauggcgcucacacaacuccuucaccugccaagucacccacgaaggcgacaccguagaaaaaucucucucccccgccgaaugccua

SEQ ID NO: 61437 - protein, 236 aa, Artificial Sequence
  Protein (LC) encoded by mRNA R5231
MAWISLILSLLALSSGAISQSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKSTPTLTVFPPSSEELKENKATLVCLISNFSPSGVTVAWKANGTPITQGVDTSNPTKEGNKFMASSFLHLTSDQWRSHNSFTCQVTHEGDTVEKSLSPAECL

SEQ ID NO: 61438 - RNA, 711 nt, Artificial Sequence
  CDS (LC) encoded by mRNA R5231
auggccuggaucagccugauccucucccugcuggcccucagcuccggcgcgaucagccaguccgcccugacccagccccgcagcguguccgggagcccgggccaguccgucaccaucagcugcacggggaccuccagcgacaucggcggguacaacuucguguccugguaccagcagcaccccggcaaggcccccaagcugaugaucuacgacgccaccaagcggcccagcggcgugccggaccgcuucuccgggagcaaguccggcaacaccgccagccucacgaucuccgggcugcaggcggaggacgaggccgacuacuacugcugcagcuacgccggcgacuacacccccggggucguguucggcggcgggaccaagcugaccgugcucggccagcccaagagcacgcccacccugaccgucuucccgcccuccagcgaggagcugaaggagaacaaggccacccucgugugccugaucuccaacuucagccccuccggggugacggucgcguggaaggccaacggcacccccaucacccagggcguggacaccagcaacccgacgaaggaggggaacaaguucauggccuccagcuuccugcaccucaccuccgaccaguggcggagccacaacuccuucacgugccaggugacccacgagggcgacacggucgagaagagccugucccccgccgagugccuguga

SEQ ID NO: 61439 - RNA, 1113 nt, Artificial Sequence
  R5231
gggucccgcagucggcguccagcggcucugcuuguucgugugugugucguugcaggccuuauucaagcuuaccauggccuggaucagccugauccucucccugcuggcccucagcuccggcgcgaucagccaguccgcccugacccagccccgcagcguguccgggagcccgggccaguccgucaccaucagcugcacggggaccuccagcgacaucggcggguacaacuucguguccugguaccagcagcaccccggcaaggcccccaagcugaugaucuacgacgccaccaagcggcccagcggcgugccggaccgcuucuccgggagcaaguccggcaacaccgccagccucacgaucuccgggcugcaggcggaggacgaggccgacuacuacugcugcagcuacgccggcgacuacacccccggggucguguucggcggcgggaccaagcugaccgugcucggccagcccaagagcacgcccacccugaccgucuucccgcccuccagcgaggagcugaaggagaacaaggccacccucgugugccugaucuccaacuucagccccuccggggugacggucgcguggaaggccaacggcacccccaucacccagggcguggacaccagcaacccgacgaaggaggggaacaaguucauggccuccagcuuccugcaccucaccuccgaccaguggcggagccacaacuccuucacgugccaggugacccacgagggcgacacggucgagaagagccugucccccgccgagugccugugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61440 - protein, 457 aa, Artificial Sequence
  Protein (HC) w/o signal peptide encoded by mRNA R3996, R3998, R4000, R4002, R4004, R4012, R4112, R4114, R4530, R4531, R4633, R4639
EVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61441 - protein, 215 aa, Artificial Sequence
  Protein (LC) w/o signal peptide encoded by mRNA R3996, R3998, R4000, R4002, R4004, R4012, R4112, R4114, R4530, R4531, R4633, R4639
EIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61442 - RNA, 1371 nt, Artificial Sequence
  CDS (HC) w/o signal peptide as RNA from mRNA R3996, R3998, R4000, R4002, R4004, R4012, R4112, R4114, R4530, R4531, R4633, R4639
gagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaag

SEQ ID NO: 61443 - RNA, 645 nt, Artificial Sequence
  CDS (LC) w/o signal peptide as RNA from mRNA R3996, R3998, R4000, R4002, R4004, R4012, R4112, R4114, R4530, R4531, R4633, R4639
gagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugc

SEQ ID NO: 61444 - RNA, 1371 nt, Artificial Sequence
  derived and/or modified sequence opt2 from CDS (HC) w/o signal peptide as RNA from mRNA R3996, R3998, R4000, R4002, R4004, R4012, R4112, R4114, R4530, R4531, R4633, R4639
gagguccagcucgucgagaccggcggcggccucguccagcccggccgcucccuccgccucuccugcgccgccuccggcuucuccuucgacgaguacaccaugcacuggguccgccaggcccccggcaagggccucgagugggucgccggcaucaacuggaagggcaacuucaugggcuacgccgacuccguccagggccgcuucaccaucucccgcgacaacggcaagaacucccucuaccuccagaugaacucccuccgcgccgaggacaccgcccucuacuacugcgccaaggaccgccucgaguccuccgccauggacauccucgagggcggcaccuucgacaucuggggccagggcaccauggucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61445 - RNA, 645 nt, Artificial Sequence
  derived and/or modified sequence opt2 from CDS (LC) w/o signal peptide as RNA from mRNA R3996, R3998, R4000, R4002, R4004, R4012, R4112, R4114, R4530, R4531, R4633, R4639
gagaucguccucacccagucccccggcacccucucccucucccccggcgagcgcgccacccucuccugccgcgccucccaguccgucuccuccuccuaccucgccugguaccagcagaagcccggccaggccccccgccuccucaucuacggcgccuccacccgcgccaccggcauccccgcccgcuucuccggcuccggcuccggcaccgacuucacccucaccaucucccgccucgagcccgaggaccucgccgucuacuacugccagcaguacggcuccucccccuggaccuucggccagggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61446 - RNA, 1371 nt, Artificial Sequence
  derived and/or modified sequence opt3 from CDS (HC) w/o signal peptide as RNA from mRNA R3996, R3998, R4000, R4002, R4004, R4012, R4112, R4114, R4530, R4531, R4633, R4639
gaggugcagcuggucgaaaccggcgggggacucguucaacccgguagaagccuuaggcuguccugcgccgcuucuggcuucucauuugacgaguacacaaugcacugggugcggcaggcaccugggaagggauuggaauggguagccggcaucaacuggaaagguaauuucaugggguaugcggauagugugcagggacgcuuuacuauuagccgagacaacggcaaaaauuccuuauaccugcagaugaacucucuacgugcugaggauacggcccucuauuacugugcaaaggacagacuggaaucgucagccauggauauacuugagggcgggaccuucgacaucuggggacaagguacaauggucacugugagcagugcuuccaccaagggcccaucuguuuuuccgcuggcacccagcuccaaaucaacaagugggggaaccgccgcuuugggcugccucgugaaggauuauuucccugagccagucacugugagcuggaacucuggugcccugacauccgggguacauaccuuucccgcgguucugcagucaagcggacucuacaguuuaucuuccguggucacggugccuagcucgucucugggcacucagaccuauauuuguaaugugaaucacaagccauccaacacaaaagucgacaagaaaguugaacccaagucaugcgauaaaacucauaccuguccuccaugcccggcacccgagcuuuugggcgggccuaguguguuccuguuuccacccaagccuaaggacacacuaaugaucagcaggaccccagaaguaacguguguggucguggauguuucccacgaggaccccgaggugaaauucaauugguacgucgauggaguggaaguacauaacgccaagacuaaaccgcgggaggaacaguacaauucuacauaucgcguugugagcguccucaccgugcugcaccaagacuggcuuaacgguaaggaguacaaaugcaaggucucaaauaaagcucugccugcccccauugaaaagacuaucaguaaggcaaaaggccagccaagagagccucagguguauacauugcccccauccagggacgagcucaccaagaaccagguuagccugacguguuuagugaaaggguuuuaccccucugauauagcuguagaaugggagucaaauggacaaccugaaaacaacuauaagaccacaccaccgguccuggacagugauggcagcuucuuucucuacuccaaacuuacuguggacaagucucgguggcagcaggguaauguuuucucgugcagcgugaugcacgaggcccugcauaaccacuauacccaaaaguccuugucacuaagucccgggaaa

SEQ ID NO: 61447 - RNA, 645 nt, Artificial Sequence
  derived and/or modified sequence opt3 from CDS (LC) w/o signal peptide as RNA from mRNA R3996, R3998, R4000, R4002, R4004, R4012, R4112, R4114, R4530, R4531, R4633, R4639
gagaucgugcugacccagagccccggcacacucucccuuucuccuggggaaagagccacucugucaugcagggcuagucaaagcgucuccucuucguacuuggcaugguaucagcagaagccaggacaggccccgcgguuacugauuuacggugcgucaacgcgcgcuaccggcauacccgcccgauucagcgggaguggauccggcacagacuuuacucuaaccaucucucgucucgagccugaagaucuggcaguuuauuacugucaacaguaugguagcuccccauggacauucgggcagggaaccaaaguggagauuaagagaacuguagccgcucccucaguguuuaucuucccuccaagugacgaacagcuuaaaagcggcacagcaucugucgugugccuguugaacaauuuuuaccccagggaggccaagguucaauggaaaguggauaacgcucuccaguccggcaauucacaggagagcgucaccgaacaggacaguaaggauucuacguauucccugagcucgacucugacccucucuaaggccgacuacgagaaacacaagguguacgcgugugaaguaacacaucaaggguuauccucaccuguuacuaaaaguuucaaccggggagagugc

SEQ ID NO: 61448 - RNA, 1371 nt, Artificial Sequence
  derived and/or modified sequence opt4 from CDS (HC) w/o signal peptide as RNA from mRNA R3996, R3998, R4000, R4002, R4004, R4012, R4112, R4114, R4530, R4531, R4633, R4639
gaggugcagcugguggagaccggcggcggccuggugcagcccggcagaagccugagacugagcugcgccgccagcggcuucagcuucgacgaguacaccaugcacugggugagacaggcccccggcaagggccuggaguggguggccggcaucaacuggaagggcaacuucaugggcuacgccgacagcgugcagggcagauucaccaucagcagagacaacggcaagaacagccuguaccugcagaugaacagccugagagccgaggacaccgcccuguacuacugcgccaaggacagacuggagagcagcgccauggacauccuggagggcggcaccuucgacaucuggggccagggcaccauggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61449 - RNA, 645 nt, Artificial Sequence
  derived and/or modified sequence opt4 from CDS (LC) w/o signal peptide as RNA from mRNA R3996, R3998, R4000, R4002, R4004, R4012, R4112, R4114, R4530, R4531, R4633, R4639
gagaucgugcugacccagagccccggcacccugagccugagccccggcgagagagccacccugagcugcagagccagccagagcgugagcagcagcuaccuggccugguaccagcagaagcccggccaggcccccagacugcugaucuacggcgccagcaccagagccaccggcauccccgccagauucagcggcagcggcagcggcaccgacuucacccugaccaucagcagacuggagcccgaggaccuggccguguacuacugccagcaguacggcagcagccccuggaccuucggccagggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61450 - RNA, 1371 nt, Artificial Sequence
  derived and/or modified sequence opt5 from CDS (HC) w/o signal peptide as RNA from mRNA R3996, R3998, R4000, R4002, R4004, R4012, R4112, R4114, R4530, R4531, R4633, R4639
gaggugcagcuggucgaaaccggcgggggacucguucaacccggcagaagccugcggcuuuccugcgccgcuucuggguucagcuuugacgaguacacaaugcacugggugcgccaggccccuggaaagggccuggaauggguggcggggaucaacuggaaaggaaauuucaugggcuaugcugauuccguccagggcagauuuacgauuucucgggacaacgggaagaauagccucuaccugcagaugaacucccuucgcgccgaggauaccgcccuguauuacugugcuaaagacagacucgaaucuagcgccauggauauccuggagggaggcacauucgacauuugggggcaaggaaccauggugacaguuuccagcgcuucuaccaagggcccguccguguuuccccuggccccuagcucuaaauccacaagcgggggaaccgcggcccucggcugccuggucaaggauuauuuccccgagccugugacgguuucuuggaacuccggcgcucuuaccagcggggugcauacauuucccgccguccugcaguccucuggacucuacagccuguccagcguggugaccgucccuucuuccagccuuggcacacagaccuauaucuguaauguuaaucacaagccgucuaacacgaaaguggacaagaaaguggaacccaagagcugcgauaaaacacauaccuguccucccugcccugcucccgagcugcucgggggaccguccgucuuccuguuuccucccaagccuaaggacacacugaugauuucucggacccccgaagugaccuguguuguggucgaugugagccacgaggaccccgagguuaaauucaauugguacguggauggcgucgaagugcauaacgccaagacaaaaccucgcgaggaacaguacaauuccacguauagagucgugagcguucucaccgugcugcaccaagacuggcuuaacgggaaggaguacaaaugcaaggucucuaauaaagcgcugccggcccccaucgaaaagacaaucuccaaggcuaaaggacagccucgggagccccagguguauacccucccucccagccgcgacgagcugacaaagaaccagguuucucuuaccugucuggugaaaggcuuuuacccguccgauauugccgucgaaugggagagcaauggccaaccugaaaacaacuauaagacgacacccccugugcucgacuccgaugggucuuucuuucuguacagcaaacugaccguggacaaguccagauggcagcagggaaauguuuucucuugcagcgucaugcacgaggcucuccauaaccacuauacccaaaagucccugagccuuucucccggcaaa

SEQ ID NO: 61451 - RNA, 645 nt, Artificial Sequence
  derived and/or modified sequence opt5 from CDS (LC) w/o signal peptide as RNA from mRNA R3996, R3998, R4000, R4002, R4004, R4012, R4112, R4114, R4530, R4531, R4633, R4639
gagaucgugcugacccagagccccggcacacucucccugucuccuggggaaagagccacgcuuagcugccgggcuucccaaucugucagcuccucuuaccuggccugguaucagcagaagccgggacaggcgccccgccuccugauuuacggcgcuagcaccagagccacagggaucccugcccgguucuccggaagcggcucugggaccgacuuuacacuuaccauuucccgccuggagcccgaagaucucgcuguuuauuacugucaacaguauggaagcucuccuuggacauucggccagggcaccaaaguggagaucaagagaacgguggccgcucccuccgucuuuauuuucccuccgagcgacgaacagcugaaaucugggaccgccuccgugguuugccugcucaacaauuuuuacccccgggaggcgaaggugcaauggaaagucgauaacgcccugcagagcggaaauucccaggagucugugacagaacaggacagcaaggauuccaccuauagccuuucuuccacacugacccucagcaaggcugacuacgagaaacacaagguuuacgccugugaagugacgcaucaaggccugucuagcccugucacaaaauccuucaaccgcggggagugc

SEQ ID NO: 61452 - RNA, 1371 nt, Artificial Sequence
  derived and/or modified sequence opt6 from CDS (HC) w/o signal peptide as RNA from mRNA R3996, R3998, R4000, R4002, R4004, R4012, R4112, R4114, R4530, R4531, R4633, R4639
gaaguacaacuuguagaaacaggagguggacuuguccaaccaggcagaagucuaagacuuucuugcgcagcaucuggauuuucauuugaugaauacacaaugcacuggguuagacaagcacccggaaaaggacuagaauggguugcuggaauaaacuggaaaggaaauuuuaugggauaugcagacucaguacaaggccguuucaccauuuccagagauaauggaaaaaacagucuuuacuuacaaaugaauucacuaagagccgaagacacagcauuauauuacugugcaaaagauagacuagaaucaagcgcuauggacauacuagaaggaggaacauuugacauauggggacaaggaacaaugguaacagucaguucagcaucaacaaaaggaccaucaguauuuccuuuagccccauccucaaaaucuacauccggaggaaccgcagcauuagguugucuaguaaaagauuacuuuccagaaccaguaacaguauccuggaauaguggcgcauuaacauccgguguacauacauuuccagcaguacuacaaucaucaggguuguacucacuaucaucaguuguaacaguuccaucaucaucccuaggaacacaaacauacauauguaacguaaaccauaaaccaucaaauacaaaagucgauaaaaaagucgaaccaaaaucaugugauaaaacacacacuugucccccauguccagcaccagaacucuuaggaggaccaucaguauuccuauuuccuccaaaaccaaaagacacauuaaugaucucaagaacaccagaaguaacauguguagucguugacgucucacaugaagauccagaaguaaaauuuaacugguaugucgauggugucgaaguucauaaugcaaaaacuaaaccaagagaagaacaauauaacucaacuuaccguguuguaucaguauuaacuguccuacaucaagacugguuaaacgguaaagaauacaaaugcaaaguaagcaauaaagcacuaccagcaccaauugaaaaaaccauuucaaaagcaaaaggacaaccaagagaaccgcaaguauauacauuaccuccaucacgagaugaauuaacaaaaaaucaaguaagucuaacaugccuaguaaaaggauuuuauccauccgacauagcuguagaaugggaaagcaauggccaaccagaaaacaauuauaaaacaaccccacccguauuagauuccgauggaucauuuuuuuuauauucuaaacucacgguugauaaaucacgauggcaacaaggaaacguauuuucaugcucuguaaugcacgaagcauuacacaaccacuauacacaaaaaucucuaucacuaucaccagguaaa

SEQ ID NO: 61453 - RNA, 645 nt, Artificial Sequence
  derived and/or modified sequence opt6 from CDS (LC) w/o signal peptide as RNA from mRNA R3996, R3998, R4000, R4002, R4004, R4012, R4112, R4114, R4530, R4531, R4633, R4639
gaaauaguacuaacacaaucaccaggaacacuaucacuaucaccaggagaaagagcaacacuaucaugcagagcaucacaaucaguaucuucaucauaccuagcaugguaccaacaaaaaccaggacaagccccaagacuacuaaucuacggagcaucuacaagagcaacaggaauaccagcaagauucucagguucaggaucaggaacagacuuuacacuaacaauaucaagauuagaaccagaagaccuagcaguauacuacugccaacaauauggaucaucaccauggacauuuggacaaggaacaaaaguagaaauaaaaagaacaguagcagcaccaucaguauucauauucccaccaucagacgaacaacuaaaaucuggaacagcaucaguaguauguuuacuaaacaacuucuacccaagagaagcaaaaguacaauggaaaguagacaacgcacuccaaucaggaaacucccaagaaucaguaacagaacaagacuccaaagacucaacauacucacuaagcucaacacuaacauuauccaaagcagacuacgaaaaacacaaaguauacgcaugcgaaguaacucaccaaggacucucaucaccaguaacuaaaucauucaacagaggagaaugc

SEQ ID NO: 61454 - RNA, 1371 nt, Artificial Sequence
  derived and/or modified sequence opt11 from CDS (HC) w/o signal peptide as RNA from mRNA R3996, R3998, R4000, R4002, R4004, R4012, R4112, R4114, R4530, R4531, R4633, R4639
gaaguucaacucgucgaaaccggcggaggacuuguccaacccggacgcagccuccgccucuccugcgccgccucaggauucuccuucgacgaguacaccaugcacuggguccgccaagcccccggcaaaggccuagaauggguugccggcaucaacuggaaaggcaacuucaugggauacgccgacucaguacaaggccgcuucaccauaagccgcgacaacggcaaaaacucacuauaucuacaaaugaacucccuacgcgcugaagacaccgcccucuacuacugcgccaaagaccgacucgaauccuccgcaauggacauccucgaaggcggcacauucgacauauggggacaaggaaccauggucaccgucuccucagccucgaccaagggcccauccgucuucccccuagccccguccucuaaaucaaccuccggcggaaccgccgcccugggcugccucgucaaagacuacuuccccgaacccguaaccgucagcuggaacuccggagcacucaccuccggcguccacaccuucccagccgugcuccaaucaagcggccucuacucgcucucaucagucguaaccguccccuccucgucacucggcacccaaaccuacaucugcaacguaaaccacaaacccuccaacacaaaagucgacaagaaagucgaaccaaaauccugcgacaaaacccacacaugcccacccugccccgcacccgaacuccuuggcggccccuccguauuccucuuucccccaaaacccaaagacacucucaugauaagccgaacccccgaaguaaccugcgucgucgucgacgucucccaugaagaccccgaagucaaauucaacugguacgucgacggcgucgaaguccacaacgccaaaaccaagccccgcgaagaacaauacaacuccaccuaccgcguagucucaguccucaccguccuccaccaagacuggcucaacggcaaagaauacaaaugcaaagucuccaacaaagcccuccccgccccaaucgagaaaaccauauccaaagcaaaaggccaaccacgcgaaccacaagucuacacccuaccacccagccgcgacgaacucaccaaaaaccaagucucccuaacgugccuagucaaaggcuucuaccccuccgacaucgccgucgaaugggaaucaaauggacaacccgaaaauaacuacaaaacaacucccccaguucuagacagcgacggcucauucuuccucuacagcaaacucaccgucgacaaaagccgcuggcaacaaggcaacgucuucuccugcuccgucaugcacgaagcacuccauaaccacuacacccagaaaagccuaucacucuccccaggaaaa

SEQ ID NO: 61455 - RNA, 645 nt, Artificial Sequence
  derived and/or modified sequence opt11 from CDS (LC) w/o signal peptide as RNA from mRNA R3996, R3998, R4000, R4002, R4004, R4012, R4112, R4114, R4530, R4531, R4633, R4639
gaaauaguccucacccaaucccccggcacccucucccucucccccggcgaacgcgccacccuuuccugccgcgcaucccaauccgucucauccuccuaccucgccugguaccaacaaaaacccggccaagccccccgccuccuaaucuacggcgccuccacccgcgcaaccggcauccccgcccgcuucuccggcucaggcuccggcacagacuucacucuaaccaucucccgccucgaacccgaagaccucgccgucuacuacugccaacaauacggcuccucacccuggaccuucggccaaggcaccaaagucgaaaucaaacgcacagucgccgcccccuccgucuucauauucccccccuccgacgaacaacucaaauccggaaccgccuccgucgucugccuacucaacaacuucuacccccgcgaagcaaaaguacaauggaaagucgacaacgcacuccaauccggcaacucccaagaaucugucaccgaacaagacucaaaagacuccaccuacucccuauccuccacacucacccucucaaaagcagacuacgaaaaacacaaagucuacgccugcgaagucacccaccaaggccuauccucccccgucaccaaaucuuucaaccgcggagaaugc

SEQ ID NO: 61456 - protein, 476 aa, Artificial Sequence
  Protein 1 (HC) encoded by mRNA R3996, R4112, R4530, R4633, R4639
MELGLSWIFLLAILKGVQCEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61457 - protein, 235 aa, Artificial Sequence
  Protein 2 (LC) encoded by mRNA R3996, R4114, R4531, R4633, R4639
METPAQLLFLLLLWLPDTTGEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61458 - RNA, 1431 nt, Artificial Sequence
  CDS 1 (HC) as RNA from mRNA R3996, R4112, R4530, R4633, R4639
auggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaguga

SEQ ID NO: 61459 - RNA, 708 nt, Artificial Sequence
  CDS 2 (LC) as RNA from mRNA R3996, R4114, R4531, R4633, R4639
auggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61460 - RNA, 1635 nt, Artificial Sequence
  R4112
gggagaaagcuuaccauggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61461 - RNA, 1833 nt, Artificial Sequence
  R4530
gggucccgcagucggcguccagcggcucugcuuguucgugugugugucguugcaggccuuauucaagcuuaccauggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61462 - RNA, 912 nt, Artificial Sequence
  R4114
gggagaaagcuuaccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61463 - RNA, 1110 nt, Artificial Sequence
  R4531
gggucccgcagucggcguccagcggcucugcuuguucgugugugugucguugcaggccuuauucaagcuuaccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61464 - RNA, 2810 nt, Artificial Sequence
  CDS (HC)-IRES-CDS (LC) as RNA from mRNA R3996, R4633
auggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61465 - RNA, 3002 nt, Artificial Sequence
  R3996
gggagaaagcuuaccauggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61466 - RNA, 3212 nt, Artificial Sequence
  R4633
gggucccgcagucggcguccagcggcucugcuuguucgugugugugucguugcaggccuuauucaagcuuaccauggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61467 - RNA, 2202 nt, Artificial Sequence
  CDS (HC)-F2A-CDS (LC) as RNA from mRNA R4639
auggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaggugaagcagacacucaauuucgaccuucugaaguuggcuggagauguugagucuaacccaggccccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61468 - RNA, 2604 nt, Artificial Sequence
  R4639
gggucccgcagucggcguccagcggcucugcuuguucgugugugugucguugcaggccuuauucaagcuuaccauggagcugggccucagcuggaucuuccugcuggccauccucaagggggugcagugcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaggugaagcagacacucaauuucgaccuucugaaguuggcuggagauguugagucuaacccaggccccauggagacccccgcccagcugcucuuccugcugcuccuguggcugccggacaccacgggcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61469 - protein, 478 aa, Artificial Sequence
  Protein 1 (HC) encoded by mRNA R3998
MDAMKRGLCCVLLLCGAVFVSEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61470 - protein, 236 aa, Artificial Sequence
  Protein 2 (LC) encoded by mRNA R3998
MDAMKRGLCCVLLLCGAVFVSEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61471 - RNA, 1437 nt, Artificial Sequence
  CDS 1 (HC) as RNA from mRNA R3998
auggacgccaugaagcgcggccugugcugcgugcuccugcugugcggggccgucuucgugagcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaguga

SEQ ID NO: 61472 - RNA, 711 nt, Artificial Sequence
  CDS 2 (LC) as RNA from mRNA R3998
auggacgccaugaagcgcggccugugcugcgugcuccugcugugcggggccgucuucgugagcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61473 - RNA, 2819 nt, Artificial Sequence
  CDS (HC)-IRES-CDS (LC) as RNA from mRNA R3998
auggacgccaugaagcgcggccugugcugcgugcuccugcugugcggggccgucuucgugagcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61474 - RNA, 3011 nt, Artificial Sequence
  R3998
gggagaaagcuuaccauggacgccaugaagcgcggccugugcugcgugcuccugcugugcggggccgucuucgugagcgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggacgccaugaagcgcggccugugcugcgugcuccugcugugcggggccgucuucgugagcgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61475 - protein, 475 aa, Artificial Sequence
  Protein 1 (HC) encoded by mRNA R4000
MKWVTFISLLFLFSSAYSEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61476 - protein, 233 aa, Artificial Sequence
  Protein 2 (LC) encoded by mRNA R4000
MKWVTFISLLFLFSSAYSEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61477 - RNA, 1428 nt, Artificial Sequence
  CDS 1 (HC) as RNA from mRNA R4000
augaagugggugaccuucaucagccugcucuuccuguucuccagcgccuacuccgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaguga

SEQ ID NO: 61478 - RNA, 702 nt, Artificial Sequence
  CDS 2 (LC) as RNA from mRNA R4000
augaagugggugaccuucaucagccugcucuuccuguucuccagcgccuacuccgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61479 - RNA, 2801 nt, Artificial Sequence
  CDS (HC)-IRES-CDS (LC) as RNA from mRNA R4000
augaagugggugaccuucaucagccugcucuuccuguucuccagcgccuacuccgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugaagugggugaccuucaucagccugcucuuccuguucuccagcgccuacuccgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61480 - RNA, 2993 nt, Artificial Sequence
  R4000
gggagaaagcuuaccaugaagugggugaccuucaucagccugcucuuccuguucuccagcgccuacuccgagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccaugaagugggugaccuucaucagccugcucuuccuguucuccagcgccuacuccgagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61481 - protein, 482 aa, Artificial Sequence
  Protein 1 (HC) encoded by mRNA R4002
MAVMAPRTLVLLLSGALALTQTWAGEVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61482 - protein, 240 aa, Artificial Sequence
  Protein 2 (LC) encoded by mRNA R4002
MAVMAPRTLVLLLSGALALTQTWAGEIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61483 - RNA, 1449 nt, Artificial Sequence
  CDS 1 (HC) as RNA from mRNA R4002
auggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaguga

SEQ ID NO: 61484 - RNA, 723 nt, Artificial Sequence
  CDS 2 (LC) as RNA from mRNA R4002
auggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61485 - RNA, 2633 nt, Artificial Sequence
  CDS (HC)-IRES-CDS (LC) as RNA from mRNA R4002
auggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61486 - RNA, 2837 nt, Artificial Sequence
  R4002
gggagaaagcuuaccauggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugaagcagguuuccccaacugacacaaaacgugcaacuugaaacuccgccuggucuuuccaggucuagagggguaacacuuuguacugcguuuggcuccacgcucgauccacuggcgaguguuaguaacagcacuguugcuucguagcggagcaugacggccgugggaacuccuccuugguaacaaggacccacggggccaaaagccacgcccacacgggcccgucaugugugcaaccccagcacggcgacuuuacugcgaaacccacuuuaaagugacauugaaacugguacccacacacuggugacaggcuaaggaugcccuucagguaccccgagguaacacgcgacacucgggaucugagaaggggacuggggcuucuauaaaagcgcucgguuuaaaaagcuucuaugccugaauaggugaccggaggucggcaccuuuccuuuacaauuaaagacccuauggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61487 - protein, 240 aa, Artificial Sequence; identical to SEQ ID NO: 61482
  Protein 1 (LC) encoded by mRNA R4004

SEQ ID NO: 61488 - protein, 482 aa, Artificial Sequence; identical to SEQ ID NO: 61481
  Protein 2 (HC) encoded by mRNA R4004

SEQ ID NO: 61489 - RNA, 723 nt, Artificial Sequence; identical to SEQ ID NO: 61484
  CDS 1 (LC) as RNA from mRNA R4004

SEQ ID NO: 61490 - RNA, 1449 nt, Artificial Sequence; identical to SEQ ID NO: 61483
  CDS 2 (HC) as RNA from mRNA R4004

SEQ ID NO: 61491 - RNA, 2843 nt, Artificial Sequence
  CDS (LC)-IRES-CDS (HC) as RNA from mRNA R4004
auggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaaguga

SEQ ID NO: 61492 - RNA, 3035 nt, Artificial Sequence
  R4004
gggagaaagcuuaccauggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61493 - protein, 482 aa, Artificial Sequence; identical to SEQ ID NO: 61481
  Protein 1 (HC) encoded by mRNA R4012

SEQ ID NO: 61494 - protein, 240 aa, Artificial Sequence; identical to SEQ ID NO: 61482
  Protein 2 (LC) encoded by mRNA R4012

SEQ ID NO: 61495 - RNA, 1449 nt, Artificial Sequence; identical to SEQ ID NO: 61483
  CDS 1 (HC) as RNA from mRNA R4012

SEQ ID NO: 61496 - RNA, 723 nt, Artificial Sequence; identical to SEQ ID NO: 61484
  CDS 2 (LC) as RNA from mRNA R4012

SEQ ID NO: 61497 - RNA, 2843 nt, Artificial Sequence
  CDS (HC)-IRES-CDS (LC) as RNA from mRNA R4004
auggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcuga

SEQ ID NO: 61498 - RNA, 3035 nt, Artificial Sequence
  R4012
gggagaaagcuuaccauggccgugauggccccgcggacccugguccuccugcugagcggcgcgcucgcccugacccagacgugggccggggagguccagcugguggagaccggcgggggccuggugcagcccgggcgcucccuccggcugagcugcgccgcguccggcuucagcuucgacgaguacaccaugcacuggguccgccaggccccgggcaaggggcuggaguggguggccggcaucaacuggaaggggaacuucaugggcuacgccgacuccgugcaggggcgguucacgaucagccgcgacaacggcaagaacucccucuaccugcagaugaacagccugcgggccgaggacaccgcgcucuacuacugcgccaaggaccgccuggaguccagcgccauggacauccuggagggcgggaccuucgacaucuggggccaggggaccauggucacgguguccagcgccuccaccaagggccccagcguguucccccucgcgcccuccagcaaguccaccagcggcgggaccgccgcccugggcugccuggucaaggacuacuucccggagcccgugacgguguccuggaacagcggggcccucaccagcggcguccacaccuuccccgccgugcugcaguccagcgggcuguacucccucagcuccguggucaccgugcccagcuccagccugggcacgcagaccuacaucugcaacgugaaccacaagcccuccaacaccaaggucgacaagaagguggagcccaagagcugcgacaagacccacacgugcccgcccugcccggcgcccgagcugcucggcgggcccuccguguuccuguucccgccgaagcccaaggacacccugaugaucagccggacccccgaggucaccugcgugguggucgacgugucccacgaggaccccgaggucaaguucaacugguacguggacggcguggagguccacaacgccaagacgaagccccgcgaggagcaguacaacagcaccuaccgggugguguccguccucaccgugcugcaccaggacuggcugaacgggaaggaguacaagugcaaggugagcaacaaggcccuccccgcccccaucgagaagaccaucuccaaggccaagggccagccccgcgagccgcaggucuacacgcugccgcccagccgggacgagcugaccaagaaccaggugucccucaccugccuggugaagggguucuaccccagcgacaucgcggucgagugggagagcaacggccagcccgagaacaacuacaagaccacgccgcccgugcuggacuccgacggcagcuucuuccucuacuccaagcugaccguggacaagagccgcuggcagcaggggaacgucuucuccugcagcgugaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggagaucgugcucacccagagccccgggacccugucccugagccccggcgagcgcgccacccucuccugccgggcgagccaguccgucagcuccagcuaccuggccugguaccagcagaagcccgggcaggccccgcgccugcucaucuacggcgccuccacgcgggccaccgggauccccgcgcgcuucagcggcuccggcagcgggaccgacuucacccugacgaucucccggcuggagcccgaggaccucgccguguacuacugccagcaguacggcagcuccccguggaccuucgggcagggcaccaagguggagaucaagcgcaccgucgccgcccccagcguguucaucuucccgcccuccgacgagcagcugaagagcgggacggcguccguggucugccugcucaacaacuucuacccccgggaggccaaggugcaguggaagguggacaacgcccugcagagcggcaacagccaggaguccgucaccgagcaggacagcaaggacuccaccuacagccuguccagcacccucacgcuguccaaggccgacuacgagaagcacaagguguacgccugcgaggugacccaccagggccugagcuccccggucaccaagagcuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61499 - protein, 454 aa, Artificial Sequence
  Protein (HC) w/o signal peptide encoded by mRNA R4007
EVQLVESGPGLVKPSDILSLTCAVSGYSISSNYYWGWIRQPPGKGLEWIGSIYHSGSTYYKPSLESRLGISVDTSKNQFSLKLSFVSAADTAVYYCARHVRSGYPDTAYYFDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61500 - protein, 214 aa, Artificial Sequence
  Protein (LC) w/o signal peptide encoded by mRNA R4007
SYVLTQPPSVSVAPGETARISCGGNNIGTKVLHWYQQTPGQAPVLVVYDDSDRPSGIPERFSGSNSGNTATLTISRVEVGDEADYYCQVWDISTDQAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61501 - RNA, 1362 nt, Artificial Sequence
  CDS (HC) w/o signal peptide encoded by mRNA R4007
gagguccagcugguggaguccgggcccggccucgugaagcccagcgacauccugucccugaccugcgccgucagcggguacuccaucagcuccaacuacuacuggggcuggauccgccagccgcccgggaagggccucgaguggaucggcagcaucuaccacuccgggagcaccuacuacaagcccucccuggagagccggcugggcaucuccguggacacgagcaagaaccaguucucccucaagcugagcuucguguccgcggccgacaccgccgucuacuacugcgcccgccacgugcggagcggguacccggacaccgccuacuacuucgacaaguggggccaggggacccuggugacggucuccagcgcgagcaccaagggccccuccguguucccccucgcccccagcuccaagagcaccuccggcgggaccgccgcccugggcugccuggugaaggacuacuucccggagcccgucacggugagcuggaacuccggggcgcucaccagcggcgugcacaccuuccccgccguccugcaguccagcggccuguacucccucagcuccguggugaccguccccagcuccagccuggggacgcagaccuacaucugcaacgugaaccacaagcccuccaacaccaagguggacaagaaggucgagcccaagagcugcgacaagacccacacgugcccgcccugcccggcccccgagcugcucggcgggcccuccguguuccuguucccgccgaagcccaaggacacccugaugaucagccgcacccccgaggucaccugcgugguggucgacgugagccacgaggaccccgaggugaaguucaacugguacgucgacggcguggaggugcacaacgccaagacgaagccgcgggaggagcaguacaacuccaccuaccgcgucgugagcgugcucaccguccugcaccaggacuggcugaacgggaaggaguacaagugcaagguguccaacaaggcccuccccgcgcccaucgagaagaccaucagcaaggccaagggccagccccgggagccccagguguacacgcugccgcccucccgcgacgagcugaccaagaaccaggucagccucaccugccuggugaagggcuucuaccccuccgacaucgccguggagugggagagcaacgggcagcccgagaacaacuacaagaccacgccgcccguccuggacuccgacggcagcuucuuccucuacuccaagcugaccguggacaagagccgguggcagcaggggaacguguucuccugcagcgucaugcacgaggcccugcacaaccacuacacccagaagucccucagccuguccccgggcaag

SEQ ID NO: 61502 - RNA, 642 nt, Artificial Sequence
  CDS (LC) w/o signal peptide encoded by mRNA R4007
agcuacguccugacgcagcccccguccgugagcguggcgcccggcgagaccgcccgcaucuccugcgggggcaacaacaucgggaccaagguccuccacugguaccagcagacccccggccaggcccccgugcugguggucuacgacgacagcgaccggccguccggcauccccgagcgcuucagcggguccaacagcggcaacacggccacccugaccaucucccggguggaggugggggacgaggccgacuacuacugccaggucugggacaucagcaccgaccaggcgguguucggcgggggcacgaagcucaccgugcugggccagcccaaggccgcccccuccgucacccuguucccgcccagcuccgaggagcuccaggccaacaaggcgacccuggugugccugaucagcgacuucuaccccggggccgugacggucgccuggaaggccgacuccagccccgugaaggccggcguggagaccaccaccccguccaagcagagcaacaacaaguacgcggccagcuccuaccucagccugacgcccgagcaguggaagucccaccgcagcuacuccugccaggucacccacgaggggagcaccguggagaagaccguggcccccacggagugcucc

SEQ ID NO: 61503 - RNA, 1362 nt, Artificial Sequence
  derived and/or modified sequence opt2 from CDS (HC) w/o signal peptide encoded by mRNA R4007
gagguccagcucgucgaguccggccccggccucgucaagcccuccgacauccucucccucaccugcgccgucuccggcuacuccaucuccuccaacuacuacuggggcuggauccgccagccccccggcaagggccucgaguggaucggcuccaucuaccacuccggcuccaccuacuacaagcccucccucgagucccgccucggcaucuccgucgacaccuccaagaaccaguucucccucaagcucuccuucgucuccgccgccgacaccgccgucuacuacugcgcccgccacguccgcuccggcuaccccgacaccgccuacuacuucgacaaguggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61504 - RNA, 642 nt, Artificial Sequence
  derived and/or modified sequence opt2 from CDS (LC) w/o signal peptide encoded by mRNA R4007
uccuacguccucacccagccccccuccgucuccgucgcccccggcgagaccgcccgcaucuccugcggcggcaacaacaucggcaccaagguccuccacugguaccagcagacccccggccaggcccccguccucgucgucuacgacgacuccgaccgccccuccggcauccccgagcgcuucuccggcuccaacuccggcaacaccgccacccucaccaucucccgcgucgaggucggcgacgaggccgacuacuacugccaggucugggacaucuccaccgaccaggccgucuucggcggcggcaccaagcucaccguccucggccagcccaaggccgcccccuccgucacccucuucccccccuccuccgaggagcuccaggccaacaaggccacccucgucugccucaucuccgacuucuaccccggcgccgucaccgucgccuggaaggccgacuccucccccgucaaggccggcgucgagaccaccacccccuccaagcaguccaacaacaaguacgccgccuccuccuaccucucccucacccccgagcaguggaagucccaccgcuccuacuccugccaggucacccacgagggcuccaccgucgagaagaccgucgcccccaccgagugcucc

SEQ ID NO: 61505 - RNA, 1362 nt, Artificial Sequence
  derived and/or modified sequence opt3 from CDS (HC) w/o signal peptide encoded by mRNA R4007
gaggugcagcuggucgaaagcggccccgggcucguuaagccuuccgacauccuuucucugaccugcgccgugucaggauacaguauuagcuccaacuauuacugggguuggauaagacaaccaccgggcaaaggguuggaguggaucggaucuauuuaucacucgggcucaacauacuauaagcccagcuuagaaaguaggcuggguaucuccguagauacuucuaaaaaucaguucagccuaaagcucuccuuugugucagcugcagacacggccgucuacuauugugcgcggcaugugcgcaguggguacccugauaccgcuuacuauuucgacaaauggggacagggcacacugguuacugugagcucugccuccaccaagggcccaucagucuuuccccuugcaccuagcaguaagucuacauccgggggaaccgccgcucuggguugcuuggugaaagauuacuucccagagcccguaacuguuagcuggaacucgggcgcacucacaucuggggugcacaccuuuccugccguccugcaguccucaggacuguauagucucagcuccguggugacggucccaucuagcucauuaggcacucaaaccuacauuuguaauguuaaccauaagccgaguaauacaaaaguggacaagaaaguagaacccaaguccugcgauaagacucacaccuguccuccaugccccgcuccugagcugcuuggugggccaagcguguucuuguuucccccgaaaccuaaggacacacugaugaucucucgaacccccgaggucacgugugugguuguggaugucucacaugaagacccagaggugaaauucaacugguauguagauggaguugaagugcacaaugccaagacuaaaccucgugaggagcaguacaacaguacauauagagucgugagcguccuaaccgugcuccaccaggacuggcugaauggcaaggaauacaaaugcaagguuuccaacaaggcgcuucccgcaccaauagagaaaacuaucucuaaggccaaaggccagcccagggaaccucaaguguacacacugccaccgucgcgggaugaguugaccaagaaucagguaagccucacgugucuggucaaaggguuuuaucccuccgacauugcuguggaaugggagucaaacggacagccugagaauaacuacaagaccacaccacccguuuuagacagugaugguucuuucuuucuguauagcaagcucacuguggacaaaucccgcuggcagcaaggcaaugucuucucaugcagcgugaugcaugaagcccuucacaaccauuacacccagaagucucuguccuugaguccugggaaa

SEQ ID NO: 61506 - RNA, 642 nt, Artificial Sequence
  derived and/or modified sequence opt3 from CDS (LC) w/o signal peptide encoded by mRNA R4007
agcuacgugcugacccagcccccuuccgucucuguugccccaggcgagacagcuagaaucucaugcgggggaaacaauauugguacuaaggugcuccacugguaucaacagacgccgggccaggcacccguacuuguggucuacgacgauagugacaggccuagcgggauaccagaacgguucuccggaucuaacucgggcaauaccgccacacugacuaucucacgcguggagguuggugaugaagcggacuauuacugucaggugugggauauuagcaccgaccaagcugucuuugggggaggcacaaaauugaccguguuaggccagcccaaggccgcaccuaguguaacucuguucccacccuccucugaggaacuacaggccaacaaagcuacacucguuugccugaucagcgauuuuuauccuggggcagugaccgucgccuggaaggcugacuccucaccagugaaagccggaguggagacgacuaccccgaguaagcagagcaauaacaaguacgcggcaucuuccuaucuuucacugacacccgagcaauggaaaagccaucgaaguuacucuugucaggucacucacgaagguuccaccguugagaagacaguggccccuaccgaaugcagc

SEQ ID NO: 61507 - RNA, 1362 nt, Artificial Sequence
  derived and/or modified sequence opt4 from CDS (HC) w/o signal peptide encoded by mRNA R4007
gaggugcagcugguggagagcggccccggccuggugaagcccagcgacauccugagccugaccugcgccgugagcggcuacagcaucagcagcaacuacuacuggggcuggaucagacagccccccggcaagggccuggaguggaucggcagcaucuaccacagcggcagcaccuacuacaagcccagccuggagagcagacugggcaucagcguggacaccagcaagaaccaguucagccugaagcugagcuucgugagcgccgccgacaccgccguguacuacugcgccagacacgugagaagcggcuaccccgacaccgccuacuacuucgacaaguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61508 - RNA, 642 nt, Artificial Sequence
  derived and/or modified sequence opt4 from CDS (LC) w/o signal peptide encoded by mRNA R4007
agcuacgugcugacccagccccccagcgugagcguggcccccggcgagaccgccagaaucagcugcggcggcaacaacaucggcaccaaggugcugcacugguaccagcagacccccggccaggcccccgugcuggugguguacgacgacagcgacagacccagcggcauccccgagagauucagcggcagcaacagcggcaacaccgccacccugaccaucagcagaguggaggugggcgacgaggccgacuacuacugccaggugugggacaucagcaccgaccaggccguguucggcggcggcaccaagcugaccgugcugggccagcccaaggccgcccccagcgugacccuguucccccccagcagcgaggagcugcaggccaacaaggccacccuggugugccugaucagcgacuucuaccccggcgccgugaccguggccuggaaggccgacagcagccccgugaaggccggcguggagaccaccacccccagcaagcagagcaacaacaaguacgccgccagcagcuaccugagccugacccccgagcaguggaagagccacagaagcuacagcugccaggugacccacgagggcagcaccguggagaagaccguggcccccaccgagugcagc

SEQ ID NO: 61509 - RNA, 1362 nt, Artificial Sequence
  derived and/or modified sequence opt5 from CDS (HC) w/o signal peptide encoded by mRNA R4007
gaggugcagcuggucgaaagcggccccgggcucguuaagccuuccgacauccugucucuuaccugcgccgugagcggauacuccauuucuagcaacuauuacuggggcuggaucagacaaccgcccgggaaaggacuggaguggauuggcuccaucuaucacucugggagcacauacuauaagccuucccucgaaagccggcugggaauuucuguggauacguccaaaaaucaguucagccuuaagcugucuuuugucuccgcugccgacaccgcgguguacuauugugcucgccauguuagaagcggcuaccccgauacagccuacuauuucgacaaauggggccaggggacccucgugacagucucuuccgccagcaccaagggaccuuccguguuuccccuggcuccuucuagcaaguccacaagcggcgggaccgccgcucugggaugccucguuaaagauuacuucccggagcccgugacggucucuuggaacuccggcgcccugaccagcggggugcacacauuuccugcggugcuucagucuagcggacuguauucccucucuagcgucguuaccgugcccuccagcucucugggcacacaaaccuacaucuguaaugugaaccauaagccuuccaauacgaaagucgacaagaaaguggaacccaagagcugcgauaagacacacaccuguccgccuugccccgccccugagcuucugggcgggcccucuguuuuccucuuucccccuaaaccgaaggacacacugaugaucucccggacccccgaggugaccugugucgugguugaugugagccaugaagacccugaggucaaauucaacugguauguggauggagucgaagugcacaaugcuaagacaaaaccccgcgaggagcaguacaacuccacguauagaguugugucuguccugaccgugcuccaccaggacuggcugaauggcaaggaauacaaaugcaagguuagcaacaaggcccuuccugcucccauugagaaaacaaucuccaaggccaaagggcagccgcgggaaccucaaguguacacccugcccccuucucgcgaugagcucacaaagaaucaggucagccugaccugucuugugaaaggauuuuaucccuccgacauugcgguggaaugggagagcaacggccagccugagaauaacuacaagacgacacccccgguucuggacucugauggguccuucuuucucuauagcaagcugaccgucgacaaaucuagauggcagcaaggaaauguguucuccugcagcgugaugcaugaagcccugcacaaccauuacacccagaagucucucagccuguccccuggcaaa

SEQ ID NO: 61510 - RNA, 642 nt, Artificial Sequence
  derived and/or modified sequence opt5 from CDS (LC) w/o signal peptide encoded by mRNA R4007
agcuacgugcugacccagcccccuuccgucucuguugccccgggcgagacagcuagaaucagcugcgggggaaacaauauuggcacgaaggugcuccacugguaucaacagacccccgggcaggccccugugcuggucguguacgacgauuccgaccggcccucuggaaucccugaacgcuucagcggcuccaacucugggaauacagcgacccuuacaauuagcagaguugaggugggagaugaagcugacuauuacugucaggucugggauaucuccaccgaccaagccguguuuggcggcgggacaaaacugaccguucucggacagcccaaggccgcuccuagcgugacgcuguucccgcccucuuccgaggaacuucaggccaacaaagcuacccuggucugccucauuagcgauuuuuauccuggcgccgugacaguggcguggaaggccgacucuucccccgucaaagcugggguugagaccacaaccccuagcaagcagucuaauaacaaguacgccgcuuccagcuaucugucccugacgcccgagcaauggaaaucucaucggagcuacuccugucaggugacacacgaaggaagcaccguggagaagacagucgccccgaccgaaugcucu

SEQ ID NO: 61511 - RNA, 1362 nt, Artificial Sequence
  derived and/or modified sequence opt6 from CDS (HC) w/o signal peptide encoded by mRNA R4007
gaaguccaacuaguagaaagcggaccuggccuaguaaaaccaucagacauacuaucacuaacaugcgcaguaucaggauacuccauaucaaguaacuauuacugggguuggauaagacaaccaccaggaaaaggccuagaauggauaggguccauauaccacuccggaucaacauacuauaaaccuuccuuagaaucucgauuaggaauaucuguagauaccagcaaaaaccaauucucucuuaaauuaaguuuuguaucagcagcagacacagcaguuuauuauugcgcaagacacguacgaucagguuacccagacacugcauacuacuucgauaaauggggacaaggaacacuaguaacaguaucuucagcaucaacaaaaggacccucaguauucccacuagccccaucaucaaaaucaacaaguggagguacagcagcauuagguugccuaguaaaagacuacuuucccgaacccguaacagugucauggaacucaggagcccuaacaucaggagugcacacauuuccagcaguacuacaaucaucaggacuauacucccucagcagcguagucacugucccaucuucaucauuagguacacaaaccuauauaugcaauguaaaccacaaaccaucaaacacaaaaguagauaaaaaaguagaaccaaaaucaugugauaaaacacauacaugcccuccaugcccagcaccagaacuccuaggaggaccaucaguauucuuauucccaccaaaaccaaaagacacacuaaugauaucuagaacaccagaaguuacuugcgucguaguagacguaucccacgaagacccagaaguaaaauucaacugguauguugacggagucgaaguacacaacgcaaaaacaaaaccaagagaagaacaauacaacucaacauaccgaguaguaucaguauuaacaguacuacaccaagacuggcuaaauggaaaagaauauaaauguaaaguaucaaacaaagcucuuccugcaccaauugaaaaaacaaucuccaaagcuaaaggccaaccacgagaaccacaaguauacacacucccaccauccagagacgaauuaacaaaaaaccaaguaagucuaacuugucuaguuaaaggauuuuacccaucagacauagcagucgaaugggaaagcaacggucaaccugaaaauaacuauaaaacaaccccuccaguacuugacucugacggcuccuucuuccuuuauagcaaauuaacagucgacaaaucaagauggcaacaaggcaacguauuuucaugcucaguaaugcacgaagcacuucauaaccacuacacacaaaaaucccucucacuaucaccaggaaaa

SEQ ID NO: 61512 - RNA, 642 nt, Artificial Sequence
  derived and/or modified sequence opt6 from CDS (LC) w/o signal peptide encoded by mRNA R4007
ucauauguacuaacacaaccaccaucuguaucuguagcaccaggagaaacagcaagaauaucaugcggaggaaacaacauaggaacaaaaguacuacacugguaccaacaaacaccaggacaagcaccaguccuaguaguuuacgacgacucagacagaccaucaggaauaccagaaagauucucaggaucaaauucaggaaauacagcaacacuaacaauaucaagaguagaaguaggagacgaagcagacuacuacugccaaguaugggacauaucaacagaccaagccguauucggaggaggaacaaaacuaacaguacuaggccaaccaaaagcagcaccaucaguaacacuauucccaccaucaucagaagaacuacaagcaaacaaagccacacuaguaugccuaauaagugacuuuuacccaggagcaguaacaguagcauggaaagcagacucaucaccaguaaaagcaggaguagaaacaacaacaccaucaaaacaaucaaacaacaaauacgcagcauccucauacuuaucacuaacuccagaacaauggaaaucacacagaucauacucaugccaaguaacacacgaaggaagcacaguagaaaaaacaguagcaccaacagaaugcagc

SEQ ID NO: 61513 - RNA, 1362 nt, Artificial Sequence
  derived and/or modified sequence opt11 from CDS (HC) w/o signal peptide encoded by mRNA R4007
gaaguccagcuaguagaauccggacccggccuagucaaacccuccgacauacuaucccuaacuugcgcagucuccggauacuccaucuccagcaacuacuacuggggcuggauccgacaacccccuggaaaaggccuugaauggaucggcuccaucuaccacucaggcucaaccuacuacaaacccucccucgaaucacgccuaggcaucucagucgacacgucgaaaaaccaauucagccuaaaacucuccuucgucagcgcagcagacaccgccguauacuacugcgcacgacacguacgauccggcuacccagacacagcauacuauuucgacaaauggggccaaggaacccucgucaccgucuccuccgcuagcaccaaaggacccuccgucuucccccucgccccauccuccaagucaaccuccggcggcaccgccgcacucggcugccucgucaaagacuacuucccagaaccuguuaccgucucauggaacuccggcgcccucacauccggaguccacaccuuccccgccguccuacaaucauccggacucuacagccuguccuccgucgucacgguccccagcuccucacucggcacccaaaccuacaucugcaacgucaaccacaaaccaagcaauaccaaggucgacaaaaagguagaacccaaauccugcgacaaaacccauaccugcccacccugcccagcccccgaacuccuaggcggcccaucagucuuccuguucccacccaaacccaaagacacucucaugaucucacggacccccgaaguaaccugcgucguaguagacguaucccacgaagaccccgaaguaaaauuuaacugguacgucgacgggguagaaguccacaacgcaaaaaccaaaccccgcgaagaacaauacaacuccaccuaccgaguagucucaguacuaacaguacuccaccaagacuggcuaaacggcaaggaauacaaaugcaaagucucaaauaaagcgcuccccgcccccaucgagaaaacaaucuccaaagccaaaggccaaccccgcgaaccccaagucuacacccucccacccucacgagacgaacucacuaaaaaccaagucucccuuacaugccuggucaaagguuucuaccccuccgacaucgccgucgaaugggaaucaaacggacaacccgaaaacaacuauaaaaccaccccucccguacucgacuccgacggcuccuucuuccuauacagcaaacugaccgucgacaaaagcagauggcaacagggcaacgucuucucaugcuccgucaugcacgaagcccuccacaaccacuacacccaaaaaucccuaucccucagucccggaaaa

SEQ ID NO: 61514 - RNA, 642 nt, Artificial Sequence
  derived and/or modified sequence opt11 from CDS (LC) w/o signal peptide encoded by mRNA R4007
uccuacguccuaacucaaccccccucugucuccgucgccccaggcgaaaccgcccgcaucuccugcggaggcaacaacaucggcacaaaaguccuccacugguaccaacaaacacccggacaagcccccguccucgucgucuacgacgacagcgaccgcccauccggcauccccgaacgauucuccggcuccaacuccggaaacaccgcaacccucaccaucucccgcgucgaagucggcgacgaagccgacuacuacugccaagucugggacaucuccaccgaccaagccgucuucggcggcggcaccaaacucaccguccucggucaacccaaagccgcccccuccgucacccuauucccccccucauccgaagaacuucaagccaacaaagcaacccucgucugccucauauccgacuucuaccccggagccgucaccgucgccuggaaagcagacuccucccccgucaaagccggcgucgaaacaaccaccccauccaaacaauccaacaacaaauacgccgcauccuccuaccuaucacuaacacccgaacaguggaaaucccaccgcuccuacuccugccaagucacacacgaaggcuccacagucgaaaaaaccgucgcccccaccgaaugcucc

SEQ ID NO: 61515 - protein, 479 aa, Artificial Sequence
  Protein (HC) encoded by mRNA R4007
MAVMAPRTLVLLLSGALALTQTWAGEVQLVESGPGLVKPSDILSLTCAVSGYSISSNYYWGWIRQPPGKGLEWIGSIYHSGSTYYKPSLESRLGISVDTSKNQFSLKLSFVSAADTAVYYCARHVRSGYPDTAYYFDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61516 - protein, 239 aa, Artificial Sequence
  Protein (LC) encoded by mRNA R4008
MAVMAPRTLVLLLSGALALTQTWAGSYVLTQPPSVSVAPGETARISCGGNNIGTKVLHWYQQTPGQAPVLVVYDDSDRPSGIPERFSGSNSGNTATLTISRVEVGDEADYYCQVWDISTDQAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 61517 - RNA, 1440 nt, Artificial Sequence
  CDS (HC) encoded by mRNA R4007
auggccgugauggccccgcggacccugguccuccugcugagcggcgcgcucgcccugacccagacgugggccggggagguccagcugguggaguccgggcccggccucgugaagcccagcgacauccugucccugaccugcgccgucagcggguacuccaucagcuccaacuacuacuggggcuggauccgccagccgcccgggaagggccucgaguggaucggcagcaucuaccacuccgggagcaccuacuacaagcccucccuggagagccggcugggcaucuccguggacacgagcaagaaccaguucucccucaagcugagcuucguguccgcggccgacaccgccgucuacuacugcgcccgccacgugcggagcggguacccggacaccgccuacuacuucgacaaguggggccaggggacccuggugacggucuccagcgcgagcaccaagggccccuccguguucccccucgcccccagcuccaagagcaccuccggcgggaccgccgcccugggcugccuggugaaggacuacuucccggagcccgucacggugagcuggaacuccggggcgcucaccagcggcgugcacaccuuccccgccguccugcaguccagcggccuguacucccucagcuccguggugaccguccccagcuccagccuggggacgcagaccuacaucugcaacgugaaccacaagcccuccaacaccaagguggacaagaaggucgagcccaagagcugcgacaagacccacacgugcccgcccugcccggcccccgagcugcucggcgggcccuccguguuccuguucccgccgaagcccaaggacacccugaugaucagccgcacccccgaggucaccugcgugguggucgacgugagccacgaggaccccgaggugaaguucaacugguacgucgacggcguggaggugcacaacgccaagacgaagccgcgggaggagcaguacaacuccaccuaccgcgucgugagcgugcucaccguccugcaccaggacuggcugaacgggaaggaguacaagugcaagguguccaacaaggcccuccccgcgcccaucgagaagaccaucagcaaggccaagggccagccccgggagccccagguguacacgcugccgcccucccgcgacgagcugaccaagaaccaggucagccucaccugccuggugaagggcuucuaccccuccgacaucgccguggagugggagagcaacgggcagcccgagaacaacuacaagaccacgccgcccguccuggacuccgacggcagcuucuuccucuacuccaagcugaccguggacaagagccgguggcagcaggggaacguguucuccugcagcgucaugcacgaggcccugcacaaccacuacacccagaagucccucagccuguccccgggcaaguga

SEQ ID NO: 61518 - RNA, 720 nt, Artificial Sequence
  CDS (LC) encoded by mRNA R4007
auggccgugauggccccgcggacccugguccuccugcugagcggcgcgcucgcccugacccagacgugggccgggagcuacguccugacgcagcccccguccgugagcguggcgcccggcgagaccgcccgcaucuccugcgggggcaacaacaucgggaccaagguccuccacugguaccagcagacccccggccaggcccccgugcugguggucuacgacgacagcgaccggccguccggcauccccgagcgcuucagcggguccaacagcggcaacacggccacccugaccaucucccggguggaggugggggacgaggccgacuacuacugccaggucugggacaucagcaccgaccaggcgguguucggcgggggcacgaagcucaccgugcugggccagcccaaggccgcccccuccgucacccuguucccgcccagcuccgaggagcuccaggccaacaaggcgacccuggugugccugaucagcgacuucuaccccggggccgugacggucgccuggaaggccgacuccagccccgugaaggccggcguggagaccaccaccccguccaagcagagcaacaacaaguacgcggccagcuccuaccucagccugacgcccgagcaguggaagucccaccgcagcuacuccugccaggucacccacgaggggagcaccguggagaagaccguggcccccacggagugcuccuga

SEQ ID NO: 61519 - RNA, 2831 nt, Artificial Sequence
  CDS (HC)-IRES-CDS (LC) as RNA from mRNA R4007
auggccgugauggccccgcggacccugguccuccugcugagcggcgcgcucgcccugacccagacgugggccggggagguccagcugguggaguccgggcccggccucgugaagcccagcgacauccugucccugaccugcgccgucagcggguacuccaucagcuccaacuacuacuggggcuggauccgccagccgcccgggaagggccucgaguggaucggcagcaucuaccacuccgggagcaccuacuacaagcccucccuggagagccggcugggcaucuccguggacacgagcaagaaccaguucucccucaagcugagcuucguguccgcggccgacaccgccgucuacuacugcgcccgccacgugcggagcggguacccggacaccgccuacuacuucgacaaguggggccaggggacccuggugacggucuccagcgcgagcaccaagggccccuccguguucccccucgcccccagcuccaagagcaccuccggcgggaccgccgcccugggcugccuggugaaggacuacuucccggagcccgucacggugagcuggaacuccggggcgcucaccagcggcgugcacaccuuccccgccguccugcaguccagcggccuguacucccucagcuccguggugaccguccccagcuccagccuggggacgcagaccuacaucugcaacgugaaccacaagcccuccaacaccaagguggacaagaaggucgagcccaagagcugcgacaagacccacacgugcccgcccugcccggcccccgagcugcucggcgggcccuccguguuccuguucccgccgaagcccaaggacacccugaugaucagccgcacccccgaggucaccugcgugguggucgacgugagccacgaggaccccgaggugaaguucaacugguacgucgacggcguggaggugcacaacgccaagacgaagccgcgggaggagcaguacaacuccaccuaccgcgucgugagcgugcucaccguccugcaccaggacuggcugaacgggaaggaguacaagugcaagguguccaacaaggcccuccccgcgcccaucgagaagaccaucagcaaggccaagggccagccccgggagccccagguguacacgcugccgcccucccgcgacgagcugaccaagaaccaggucagccucaccugccuggugaagggcuucuaccccuccgacaucgccguggagugggagagcaacgggcagcccgagaacaacuacaagaccacgccgcccguccuggacuccgacggcagcuucuuccucuacuccaagcugaccguggacaagagccgguggcagcaggggaacguguucuccugcagcgucaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccgggagcuacguccugacgcagcccccguccgugagcguggcgcccggcgagaccgcccgcaucuccugcgggggcaacaacaucgggaccaagguccuccacugguaccagcagacccccggccaggcccccgugcugguggucuacgacgacagcgaccggccguccggcauccccgagcgcuucagcggguccaacagcggcaacacggccacccugaccaucucccggguggaggugggggacgaggccgacuacuacugccaggucugggacaucagcaccgaccaggcgguguucggcgggggcacgaagcucaccgugcugggccagcccaaggccgcccccuccgucacccuguucccgcccagcuccgaggagcuccaggccaacaaggcgacccuggugugccugaucagcgacuucuaccccggggccgugacggucgccuggaaggccgacuccagccccgugaaggccggcguggagaccaccaccccguccaagcagagcaacaacaaguacgcggccagcuccuaccucagccugacgcccgagcaguggaagucccaccgcagcuacuccugccaggucacccacgaggggagcaccguggagaagaccguggcccccacggagugcuccuga

SEQ ID NO: 61520 - RNA, 3023 nt, Artificial Sequence
  R4007
gggagaaagcuuaccauggccgugauggccccgcggacccugguccuccugcugagcggcgcgcucgcccugacccagacgugggccggggagguccagcugguggaguccgggcccggccucgugaagcccagcgacauccugucccugaccugcgccgucagcggguacuccaucagcuccaacuacuacuggggcuggauccgccagccgcccgggaagggccucgaguggaucggcagcaucuaccacuccgggagcaccuacuacaagcccucccuggagagccggcugggcaucuccguggacacgagcaagaaccaguucucccucaagcugagcuucguguccgcggccgacaccgccgucuacuacugcgcccgccacgugcggagcggguacccggacaccgccuacuacuucgacaaguggggccaggggacccuggugacggucuccagcgcgagcaccaagggccccuccguguucccccucgcccccagcuccaagagcaccuccggcgggaccgccgcccugggcugccuggugaaggacuacuucccggagcccgucacggugagcuggaacuccggggcgcucaccagcggcgugcacaccuuccccgccguccugcaguccagcggccuguacucccucagcuccguggugaccguccccagcuccagccuggggacgcagaccuacaucugcaacgugaaccacaagcccuccaacaccaagguggacaagaaggucgagcccaagagcugcgacaagacccacacgugcccgcccugcccggcccccgagcugcucggcgggcccuccguguuccuguucccgccgaagcccaaggacacccugaugaucagccgcacccccgaggucaccugcgugguggucgacgugagccacgaggaccccgaggugaaguucaacugguacgucgacggcguggaggugcacaacgccaagacgaagccgcgggaggagcaguacaacuccaccuaccgcgucgugagcgugcucaccguccugcaccaggacuggcugaacgggaaggaguacaagugcaagguguccaacaaggcccuccccgcgcccaucgagaagaccaucagcaaggccaagggccagccccgggagccccagguguacacgcugccgcccucccgcgacgagcugaccaagaaccaggucagccucaccugccuggugaagggcuucuaccccuccgacaucgccguggagugggagagcaacgggcagcccgagaacaacuacaagaccacgccgcccguccuggacuccgacggcagcuucuuccucuacuccaagcugaccguggacaagagccgguggcagcaggggaacguguucuccugcagcgucaugcacgaggcccugcacaaccacuacacccagaagucccucagccuguccccgggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccgggagcuacguccugacgcagcccccguccgugagcguggcgcccggcgagaccgcccgcaucuccugcgggggcaacaacaucgggaccaagguccuccacugguaccagcagacccccggccaggcccccgugcugguggucuacgacgacagcgaccggccguccggcauccccgagcgcuucagcggguccaacagcggcaacacggccacccugaccaucucccggguggaggugggggacgaggccgacuacuacugccaggucugggacaucagcaccgaccaggcgguguucggcgggggcacgaagcucaccgugcugggccagcccaaggccgcccccuccgucacccuguucccgcccagcuccgaggagcuccaggccaacaaggcgacccuggugugccugaucagcgacuucuaccccggggccgugacggucgccuggaaggccgacuccagccccgugaaggccggcguggagaccaccaccccguccaagcagagcaacaacaaguacgcggccagcuccuaccucagccugacgcccgagcaguggaagucccaccgcagcuacuccugccaggucacccacgaggggagcaccguggagaagaccguggcccccacggagugcuccugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61521 - protein, 450 aa, Artificial Sequence
  Protein (HC) w/o signal peptide encoded by mRNA R4008
QVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61522 - protein, 214 aa, Artificial Sequence
  Protein (LC) w/o signal peptide encoded by mRNA R4008
DIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61523 - RNA, 1350 nt, Artificial Sequence
  CDS (HC) w/o signal peptide encoded by mRNA R4008
caggugcagcucguccaguccggggccgaggugaaggagcccggcagcgccaugaagguguccugcaaggccagcgggggcacguucuccagcgacgccuucugcuggguccggcaggcgccggggcgcggccuggaguggaugggcgggaucauccccguguuccagaccgccaacuacggccccaacuuccaggggcgggugaccaucuccgccgacgucuacaccacgacccuguaccucgagcugagcggccugaccuccgaggacaccgccguguacuucugcgcgcgcagcggggacggcuacaacuacuacuucccccucuggggccaggggacgcuggugaccgucuccagcgccuccaccaagggcccgagcguguucccccuggcccccuccagcaaguccaccagcgggggcacggccgcccucggcugccuggugaaggacuacuuccccgagccggucaccguguccuggaacagcggggcgcugaccagcggcgugcacaccuuccccgccguccuccaguccagcgggcuguacucccugagcuccguggugacgguccccagcuccagccucggcacccagaccuacaucugcaacgugaaccacaagcccuccaacaccaagguggacaagaaggucgagcccaagagcugcgacaagacgcacaccugcccgcccugccccgccccggagcugcugggcgggcccuccguguuccucuucccgcccaagccgaaggacacccugaugaucagccggacccccgaggucacgugcgugguggucgacgugucccacgaggaccccgaggugaaguucaacugguacgucgacggcguggaggugcacaacgccaagaccaagccccgcgaggagcaguacaacagcaccuaccgggucguguccgugcugaccguccuccaccaggacuggcugaacgggaaggaguacaagugcaaggugagcaacaaggcccugccggcgcccaucgagaagacgaucuccaaggccaagggccagccccgcgagccccagguguacacccucccgcccagccgggacgagcugaccaagaaccaggucucccugaccugccucgugaagggguucuaccccagcgacaucgccguggagugggagagcaacggccagccggagaacaacuacaagacgaccccgcccguccuggacuccgacgggagcuucuuccuguacuccaagcucaccguggacaagagccgcuggcagcagggcaacguguucuccugcagcgucaugcacgaggcccugcacaaccacuacacccagaagucccugagccucucccccggcaag

SEQ ID NO: 61524 - RNA, 642 nt, Artificial Sequence
  CDS (LC) w/o signal peptide encoded by mRNA R4008
gacauccagaugacccagagccccuccacccucagcggcuccgucggggaccgggugacgaucaccugccgcgcgagccagaacaucggccccuggcuggccugguaccagcaggaguccgggaaggcccccaagcugcucaucagccgggccuccauccuggagagcggcgugcccucccgcuucagcggcaccgggaccggcacggaguucacccugaccaucuccagccuccagcccgacgacuucgccaccuacuacugccagcacuacaacgcguacugggggacguucggccaggggaccaaggucgagaucaaccggaccguggccgccccguccguguucaucuucccgccgagcgacgagcagcugaaguccggcaccgccagcgucgugugccugcucaacaacuucuacccccgcgaggcgaaggugcaguggaaggucgacaacgcccugcaguccggcaacagccaggaguccgugacggagcaggacagcaaggacagcaccuacucccugagcuccacccucacccugagcaaggccgacuacgagaagcacaagguguacgccugcgaggucacgcaccaggggcuguccagccccgugaccaaguccuucaaccggggcgagugc

SEQ ID NO: 61525 - RNA, 1350 nt, Artificial Sequence
  derived and/or modified sequence opt2 from CDS (HC) w/o signal peptide encoded by mRNA R4008
cagguccagcucguccaguccggcgccgaggucaaggagcccggcuccgccaugaaggucuccugcaaggccuccggcggcaccuucuccuccgacgccuucugcuggguccgccaggcccccggccgcggccucgaguggaugggcggcaucauccccgucuuccagaccgccaacuacggccccaacuuccagggccgcgucaccaucuccgccgacgucuacaccaccacccucuaccucgagcucuccggccucaccuccgaggacaccgccgucuacuucugcgcccgcuccggcgacggcuacaacuacuacuucccccucuggggccagggcacccucgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61526 - RNA, 642 nt, Artificial Sequence
  derived and/or modified sequence opt2 from CDS (LC) w/o signal peptide encoded by mRNA R4008
gacauccagaugacccagucccccuccacccucuccggcuccgucggcgaccgcgucaccaucaccugccgcgccucccagaacaucggccccuggcucgccugguaccagcaggaguccggcaaggcccccaagcuccucaucucccgcgccuccauccucgaguccggcguccccucccgcuucuccggcaccggcaccggcaccgaguucacccucaccaucuccucccuccagcccgacgacuucgccaccuacuacugccagcacuacaacgccuacuggggcaccuucggccagggcaccaaggucgagaucaaccgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61527 - RNA, 1350 nt, Artificial Sequence
  derived and/or modified sequence opt3 from CDS (HC) w/o signal peptide encoded by mRNA R4008
caggugcaacugguccagagcggcgccgagguuaaggaacccggguccgcuaugaaagugucuugcaaggcaucaggagguaccuucaguagcgacgccuuuuguuggguaagacaggcgccuggcagggggcucgaguggaugggaggcaucauuccaguguuccagacagcuaacuacgguccgaauuuucaagggcgggucacuauauccgccgauguguauacgaccacacuuuaccuggaauugucuggauuaacuucggaggacaccgcaguuuauuucugcgcccgcucaggcgauggcuacaacuauuacuuuccccugugggggcagggaacccuagugacagucagcagugcuuccacuaaagguccuucuguguucccacucgcacccagcuccaagucaacaaguggcgggaccgccgcucugggaugucuuguaaaagacuauuuuccugaaccaguuacggugagcuggaacucuggcgcccugacuuccgguguccacaccuuccccgcgguguugcagucaagcgggcucuacagucugucuuccguggucacaguuccuagcucgucucugggaacucagaccuacaucugcaaugugaaucauaagccauccaacacaaagguagauaaaaagguggagccgaaaucaugugacaagacccacacgugucccccuugcccagcacccgagcucuuaggcggcccuagugucuuucuguucccacccaaaccgaaggauacucuuaugauuagccgaacaccugaagugaccugcguuguggucgacgugucccaugaggaucccgaaguaaaguuuaauugguauguugacgggguggagguccacaacgccaaaacuaagccacgugaggaacaauacaauucuacauauagaguggucagcguguugaccguucugcaucaggauuggcuaaacggaaaagaguacaaguguaaagugucaaauaaggcucucccugcccccaucgagaaaacgauuaguaaggcaaagggucagccaagggaaccccagguauauacccugccuccaucccgggacgaacuuacuaaaaaccaagucagccugacaugcuuggugaagggcuucuacccgucugauaucgcuguugagugggagucaaaugggcagcccgaaaacaauuauaaaaccacaccuccagugcucgacagugacggcagcuuuuuccuguacuccaaguuaacugucgauaaaucucgcuggcagcaaggaaacguguucucguguagcguaaugcacgaggcccugcacaaccauuacacccagaagucccucucacuuagucccgguaag

SEQ ID NO: 61528 - RNA, 642 nt, Artificial Sequence
  derived and/or modified sequence opt3 from CDS (LC) w/o signal peptide encoded by mRNA R4008
gacauccagaugacccaaagccccuccacacugucuggcucagugggggauagagucacuauuacgugcagggccagucagaacauaggaccuuggcucgcuugguaccagcaggagagcgguaaggcaccaaaacuucugaucucccgggccucuauuuuggaaucgggcguuccgucacgcuucagcgggaccggaacaggcacugaguuuaccuuaacaaucaguucccugcaacccgacgauuucgcgaccuauuacugucagcacuauaaugcuuacugggguacuuuugggcagggaacaaagguggaaauuaaccgaaccguagccgcaccuucuguguucaucuuuccacccagcgacgagcagcuaaaauccggcacggccucagucgugugccuccugaauaacuucuauccucgugaagcuaagguucaauggaaaguggauaaugcacuucagaguggcaacagccaggagucugucacugagcaggacuccaaggauucaaccuacagccugaguucuacauugacucucuccaaggccgacuaugaaaaacauaagguguacgcuugugagguaacccaccaagggcugagcucgccaguuacaaaaucuuuuaauagaggagaaugc

SEQ ID NO: 61529 - RNA, 1350 nt, Artificial Sequence
  derived and/or modified sequence opt4 from CDS (HC) w/o signal peptide encoded by mRNA R4008
caggugcagcuggugcagagcggcgccgaggugaaggagcccggcagcgccaugaaggugagcugcaaggccagcggcggcaccuucagcagcgacgccuucugcugggugagacaggcccccggcagaggccuggaguggaugggcggcaucauccccguguuccagaccgccaacuacggccccaacuuccagggcagagugaccaucagcgccgacguguacaccaccacccuguaccuggagcugagcggccugaccagcgaggacaccgccguguacuucugcgccagaagcggcgacggcuacaacuacuacuucccccuguggggccagggcacccuggugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61530 - RNA, 642 nt, Artificial Sequence
  derived and/or modified sequence opt4 from CDS (LC) w/o signal peptide encoded by mRNA R4008
gacauccagaugacccagagccccagcacccugagcggcagcgugggcgacagagugaccaucaccugcagagccagccagaacaucggccccuggcuggccugguaccagcaggagagcggcaaggcccccaagcugcugaucagcagagccagcauccuggagagcggcgugcccagcagauucagcggcaccggcaccggcaccgaguucacccugaccaucagcagccugcagcccgacgacuucgccaccuacuacugccagcacuacaacgccuacuggggcaccuucggccagggcaccaagguggagaucaacagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61531 - RNA, 1350 nt, Artificial Sequence
  derived and/or modified sequence opt5 from CDS (HC) w/o signal peptide encoded by mRNA R4008
caggugcaacugguccagagcggcgccgagguuaaggaacccggguccgcuaugaaagugucuugcaaggccagcggaggcaccuucuccucugacgcguuuuguugggugagacaggcuccugggcggggacucgaguggaugggcgggaucauuccggucuuccagacagccaacuacggacccaauuuucaaggccgcgugacgaucagcgccgauguuuauaccacaacccuguaccuugaacuguccggccucacaucugaggacaccgcuguguauuucugcgccagaagcggggauggauacaacuauuacuuuccucuguggggccaggggacacuugucaccguguccagcgcuucuacgaaaggacccuccguuuucccucuggcccccagcucuaaguccaccagcggcgggacagcggcccucggaugucuggugaaagacuauuuuccugaaccggucaccgugucuuggaacuccggcgcucugacaagcggcgugcacaccuuccccgccguccuccaguccucugggcuguacagccuuuccagcguugugacggugccuucuuccagccugggaacacagaccuacauuugcaaugucaaucauaagcccucuaacacaaagguggauaaaaagguugagccuaaaagcugugacaagacccacaccugucccccgugcccugcucccgagcuccugggcgggccuuccguguuucuuuucccucccaaacccaaggauacacugaugaucucucggacgccggaagugaccugcgucguuguggacgucagccaugaggaucccgaagugaaguuuaauugguaugucgacggaguggagguucacaacgccaaaacaaagccucgcgaggaacaauacaauuccaccuauagaguggucagcgugcucacaguucugcaucaggauuggcugaacggcaaagaguacaaguguaaagugucuaauaaggcgcuccccgccccuauugagaaaaccaucuccaaggcuaaggggcagccccgggaaccgcaggucuauacgcugccucccagccgcgacgaacuuaccaaaaaccaagugucucugacaugccucgugaagggauucuacccuuccgauaucgccguugagugggagagcaauggccagcccgaaaacaauuauaaaaccacaccucccguccuggacuccgacggcagcuuuuuccuuuacucuaagcugaccguggauaaauccagauggcagcaagggaacguguucucuuguagcgucaugcacgaggcucuccacaaccauuacacacagaagucccugagccugucuccgggaaag

SEQ ID NO: 61532 - RNA, 642 nt, Artificial Sequence
  derived and/or modified sequence opt5 from CDS (LC) w/o signal peptide encoded by mRNA R4008
gacauccagaugacccaaagccccuccacacugucuggcagcgugggggauagagucacgauuaccugccgggccucccagaacaucggaccuuggcucgcuugguaccagcaggagucuggcaaagccccgaaacugcuuauuagccgcgcguccauccuggaaucugggguucccagcagauucuccggaacaggcaccgggacagaguuuacccucacaauuagcucucugcaaccugacgauuucgcuaccuauuacugucagcacuauaaugccuacuggggaacguuuggccagggcaccaagguggaaaucaaccggacaguggccgcucccuccgucuucaucuuuccucccagcgacgagcagcuuaaaucugggaccgccuccgugguuugccugcucaauaacuucuauccucgcgaagcuaaggugcaauggaaagucgauaaugcccugcagagcggaaacucucaggaguccgugacagagcaggacagcaaggauuccaccuacucucugagcuccacgcucacacugagcaaggcggacuaugaaaaacauaagguuuacgccugugaggugacccaccaaggccuuucuuccccggucacaaagagcuuuaauagaggggaaugc

SEQ ID NO: 61533 - RNA, 1350 nt, Artificial Sequence
  derived and/or modified sequence opt6 from CDS (HC) w/o signal peptide encoded by mRNA R4008
caaguucaauuaguacaaaguggugcagaagucaaagaaccuggaucagcaaugaaaguaucauguaaagcuaguggaggaacuuucucaucagacgcauuuugcuggguucgacaagccccaggaagaggcuuagaauggauggguggaauaauaccaguauuccaaaccgcaaacuacgguccaaauuuucaaggaagaguaacaauuucugcugacguauacaccacuacucuauaccuagaacuaucuggauuaacuuccgaagacaccgccguauacuucugcgcaagaucaggagacggauacaauuauuauuucccauuauggggacaaggaacacuaguaacaguuucaucagcaucaacaaaaggaccaucaguuuucccacuagcaccaucaaguaaaucaacaagcggaggcacagcagcccuaggaugccuugucaaagacuacuucccugaaccaguaaccguaucauggaacucaggugcauuaacaucaggaguacauacauucccagcaguacuacaaucaucaggacuauacucuuuaucaucaguaguaacaguaccaagcucauccuuaggaacccaaacauacauauguaauguaaaucauaaaccaucuaauacaaaaguagacaaaaaaguagaacccaaaucaugugacaaaacacacacauguccaccaugccccgcccccgaacuauuaggcggucccucagucuucuuauuccccccaaaaccaaaagauacucuaaugauaucaagaacuccugaaguaaccuguguuguugucgacguaucucacgaagacccagaagucaaauuuaacugguauguagauggaguagaaguacacaacgcaaaaacuaaaccacgagaagaacaauacaacucaacauacagaguaguuucaguccucaccguauuacaccaagacuggcuaaauggcaaagaauauaaauguaaaguaucuaacaaagcacuuccagcaccaauugaaaaaacaauaucuaaagccaaaggacaaccaagagaaccacaaguauacacucuccccccaucacgagaugaauuaacaaaaaaccaaguaucccuaacauguuuaguaaaagguuuuuacccuucagacauagcaguagaaugggaauccaacggacaaccagaaaacaauuacaaaacuacaccacccguacuagacuccgacggaucauucuuccuauauucuaaacuaacaguagacaaaucaagauggcaacaaggaaaugucuuuucuugcucaguaaugcaugaagcauuacauaaccacuacacacaaaaaucccuaucauuaucaccuggaaaa

SEQ ID NO: 61534 - RNA, 642 nt, Artificial Sequence
  derived and/or modified sequence opt6 from CDS (LC) w/o signal peptide encoded by mRNA R4008
gauauacaaaugacacaaucaccaucuacauuaagcggaagcguaggugauagaguaacaauaacauguagagcaagccaaaacauaggaccaugguuagcaugguaccaacaagaaagcgguaaagcacccaaacuauuaauaucaagagcaaguauacuagaaaguggaguaccaagcagauucucaggaacaggaacaggaacagaauuuacauuaacaauaagcucacuacaacccgacgacuuugcaacguacuauugccaacacuauaacgcauauuggggcacauucggacaaggaacaaaaguagaaauaaauagaacaguagcagcaccaagcguauucauauucccaccaucagacgaacaauuaaaaucaggaacagcaucaguagugugcuuacuaaauaacuuuuacccaagagaagcaaaaguccaauggaaagucgauaacgcacuacaaagcggaaacucacaagaaucaguaaccgaacaagauagcaaagacucuacauauagcuuaagcucaaccuuaacauuaaguaaagcagauuacgaaaaacauaaaguauacgcaugcgaaguaacacaccaaggauuaaguucaccaguaacaaaaaguuuuaacagaggagaaugc

SEQ ID NO: 61535 - RNA, 1350 nt, Artificial Sequence
  derived and/or modified sequence opt11 from CDS (HC) w/o signal peptide encoded by mRNA R4008
caaguucaacucguacaauccggcgccgaagucaaagaacccggauccgcaaugaaaguauccugcaaagcauccggaggaaccuucuccucagacgccuucugcuggguccgccaagcccccggccgaggacucgaauggaugggcggcaucauccccgucuuccagaccgccaauuacggccccaacuuccaaggccgagucaccaucucugcagacgucuauaccaccacccucuaccuagaacucagcggacucacauccgaagacaccgccgucuacuucugcgcccgcuccggagacggcuacaacuacuacuucccccucuggggacaaggaacccuagucacaguaagcuccgccucaaccaaaggacccuccgucuucccccuagcccccucaucaaaauccaccuccggcggcacggcagcccuaggcugccucgucaaagacuacuuccccgaacccguaaccgucuccuggaacucaggcgcccucaccagcggcguccacaccuuccccgcaguccuccaaucaagcggucuuuacucccuaucauccguagucaccgucccaucaagcucgcuaggcacccaaacuuacauaugcaacgucaaccacaaaccgucuaacaccaaagucgacaagaaagucgaacccaaaucuugcgacaaaacccacacaugcccacccugccccgccccagaacuacuugggggacccucagucuuccuauucccgcccaaaccuaaagacacccuaaugaucucgcgcaccccagaaguuaccugcgucgucgucgacgucucccacgaagaccccgaagucaaauucaacugguacguagacggaguagaaguucacaacgccaaaacaaaaccucgcgaggaacaauacaacuccaccuaccgcgucguaucuguucucaccguccuccaccaagacuggcucaacggcaaagaauacaaaugcaaaguaucaaacaaagcccuaccagcccccaucgagaaaacgaucucaaaagccaaaggccaaccucgcgaaccccaaguuuacacacuuccucccucccgcgacgaacuaacuaaaaaccaaguaucccucacaugccucgucaaaggauucuaccccuccgacauugccguggaaugggaauccaacggacaaccagaaaacaacuacaaaacaaccccgcccguccucgauuccgacggcucauucuuccuuuacuccaaacucaccguagacaaaucacgcuggcaacaaggcaacgucuucuccugcuccgucaugcacgaagcccuccacaaccacuacacucaaaaaucccucucacuuucccccggcaaa

SEQ ID NO: 61536 - RNA, 642 nt, Artificial Sequence
  derived and/or modified sequence opt11 from CDS (LC) w/o signal peptide encoded by mRNA R4008
gacauccaaaugacccaaucccccucaacccucuccggcuccgucggcgaccgcguaaccaucaccugccgagccucccaaaacaucggccccuggcucgccugguaccaacaagaauccggcaaagccccaaaacuccucaucucccgcgccuccauccucgaaagcggcgucccaucccgauucuccggcacaggcaccggcaccgaauucacccucaccaucagcucccuccaacccgacgacuucgccaccuacuacugccaacacuacaacgccuacuggggcacauucggccaaggaaccaaagucgaaaucaaccgcaccgucgccgcccccucagucuucaucuucccacccucagacgaacaacucaaaucaggcaccgccuccgucguaugccuccucaacaacuucuacccccgcgaagccaaaguccaauggaaagucgacaacgcacuccaauccggcaacucccaagaauccgucaccgaacaagacagcaaagacucaaccuacucccucuccucaacccuaacccuauccaaagccgacuacgaaaaacacaaagucuacgccugcgaagucacacaccaaggccuauccucacccgucaccaaaucauucaaccgcggcgaaugc

SEQ ID NO: 61537 - protein, 475 aa, Artificial Sequence
  Protein (HC) encoded by mRNA R4008
MAVMAPRTLVLLLSGALALTQTWAGQVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61538 - protein, 239 aa, Artificial Sequence
  Protein (LC) encoded by mRNA R4008
MAVMAPRTLVLLLSGALALTQTWAGDIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61539 - RNA, 1428 nt, Artificial Sequence
  CDS (HC) encoded by mRNA R4008
auggccgugauggccccgcggacccugguccuccugcugagcggcgcgcucgcccugacccagacgugggccgggcaggugcagcucguccaguccggggccgaggugaaggagcccggcagcgccaugaagguguccugcaaggccagcgggggcacguucuccagcgacgccuucugcuggguccggcaggcgccggggcgcggccuggaguggaugggcgggaucauccccguguuccagaccgccaacuacggccccaacuuccaggggcgggugaccaucuccgccgacgucuacaccacgacccuguaccucgagcugagcggccugaccuccgaggacaccgccguguacuucugcgcgcgcagcggggacggcuacaacuacuacuucccccucuggggccaggggacgcuggugaccgucuccagcgccuccaccaagggcccgagcguguucccccuggcccccuccagcaaguccaccagcgggggcacggccgcccucggcugccuggugaaggacuacuuccccgagccggucaccguguccuggaacagcggggcgcugaccagcggcgugcacaccuuccccgccguccuccaguccagcgggcuguacucccugagcuccguggugacgguccccagcuccagccucggcacccagaccuacaucugcaacgugaaccacaagcccuccaacaccaagguggacaagaaggucgagcccaagagcugcgacaagacgcacaccugcccgcccugccccgccccggagcugcugggcgggcccuccguguuccucuucccgcccaagccgaaggacacccugaugaucagccggacccccgaggucacgugcgugguggucgacgugucccacgaggaccccgaggugaaguucaacugguacgucgacggcguggaggugcacaacgccaagaccaagccccgcgaggagcaguacaacagcaccuaccgggucguguccgugcugaccguccuccaccaggacuggcugaacgggaaggaguacaagugcaaggugagcaacaaggcccugccggcgcccaucgagaagacgaucuccaaggccaagggccagccccgcgagccccagguguacacccucccgcccagccgggacgagcugaccaagaaccaggucucccugaccugccucgugaagggguucuaccccagcgacaucgccguggagugggagagcaacggccagccggagaacaacuacaagacgaccccgcccguccuggacuccgacgggagcuucuuccuguacuccaagcucaccguggacaagagccgcuggcagcagggcaacguguucuccugcagcgucaugcacgaggcccugcacaaccacuacacccagaagucccugagccucucccccggcaaguga

SEQ ID NO: 61540 - RNA, 720 nt, Artificial Sequence
  CDS (LC) encoded by mRNA R4008
auggccgugauggccccgcggacccugguccuccugcugagcggcgcgcucgcccugacccagacgugggccggggacauccagaugacccagagccccuccacccucagcggcuccgucggggaccgggugacgaucaccugccgcgcgagccagaacaucggccccuggcuggccugguaccagcaggaguccgggaaggcccccaagcugcucaucagccgggccuccauccuggagagcggcgugcccucccgcuucagcggcaccgggaccggcacggaguucacccugaccaucuccagccuccagcccgacgacuucgccaccuacuacugccagcacuacaacgcguacugggggacguucggccaggggaccaaggucgagaucaaccggaccguggccgccccguccguguucaucuucccgccgagcgacgagcagcugaaguccggcaccgccagcgucgugugccugcucaacaacuucuacccccgcgaggcgaaggugcaguggaaggucgacaacgcccugcaguccggcaacagccaggaguccgugacggagcaggacagcaaggacagcaccuacucccugagcuccacccucacccugagcaaggccgacuacgagaagcacaagguguacgccugcgaggucacgcaccaggggcuguccagccccgugaccaaguccuucaaccggggcgagugcuga

SEQ ID NO: 61541 - RNA, 2819 nt, Artificial Sequence
  CDS (HC)-IRES-CDS (LC) as RNA from mRNA R4008
auggccgugauggccccgcggacccugguccuccugcugagcggcgcgcucgcccugacccagacgugggccgggcaggugcagcucguccaguccggggccgaggugaaggagcccggcagcgccaugaagguguccugcaaggccagcgggggcacguucuccagcgacgccuucugcuggguccggcaggcgccggggcgcggccuggaguggaugggcgggaucauccccguguuccagaccgccaacuacggccccaacuuccaggggcgggugaccaucuccgccgacgucuacaccacgacccuguaccucgagcugagcggccugaccuccgaggacaccgccguguacuucugcgcgcgcagcggggacggcuacaacuacuacuucccccucuggggccaggggacgcuggugaccgucuccagcgccuccaccaagggcccgagcguguucccccuggcccccuccagcaaguccaccagcgggggcacggccgcccucggcugccuggugaaggacuacuuccccgagccggucaccguguccuggaacagcggggcgcugaccagcggcgugcacaccuuccccgccguccuccaguccagcgggcuguacucccugagcuccguggugacgguccccagcuccagccucggcacccagaccuacaucugcaacgugaaccacaagcccuccaacaccaagguggacaagaaggucgagcccaagagcugcgacaagacgcacaccugcccgcccugccccgccccggagcugcugggcgggcccuccguguuccucuucccgcccaagccgaaggacacccugaugaucagccggacccccgaggucacgugcgugguggucgacgugucccacgaggaccccgaggugaaguucaacugguacgucgacggcguggaggugcacaacgccaagaccaagccccgcgaggagcaguacaacagcaccuaccgggucguguccgugcugaccguccuccaccaggacuggcugaacgggaaggaguacaagugcaaggugagcaacaaggcccugccggcgcccaucgagaagacgaucuccaaggccaagggccagccccgcgagccccagguguacacccucccgcccagccgggacgagcugaccaagaaccaggucucccugaccugccucgugaagggguucuaccccagcgacaucgccguggagugggagagcaacggccagccggagaacaacuacaagacgaccccgcccguccuggacuccgacgggagcuucuuccuguacuccaagcucaccguggacaagagccgcuggcagcagggcaacguguucuccugcagcgucaugcacgaggcccugcacaaccacuacacccagaagucccugagccucucccccggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggacauccagaugacccagagccccuccacccucagcggcuccgucggggaccgggugacgaucaccugccgcgcgagccagaacaucggccccuggcuggccugguaccagcaggaguccgggaaggcccccaagcugcucaucagccgggccuccauccuggagagcggcgugcccucccgcuucagcggcaccgggaccggcacggaguucacccugaccaucuccagccuccagcccgacgacuucgccaccuacuacugccagcacuacaacgcguacugggggacguucggccaggggaccaaggucgagaucaaccggaccguggccgccccguccguguucaucuucccgccgagcgacgagcagcugaaguccggcaccgccagcgucgugugccugcucaacaacuucuacccccgcgaggcgaaggugcaguggaaggucgacaacgcccugcaguccggcaacagccaggaguccgugacggagcaggacagcaaggacagcaccuacucccugagcuccacccucacccugagcaaggccgacuacgagaagcacaagguguacgccugcgaggucacgcaccaggggcuguccagccccgugaccaaguccuucaaccggggcgagugcuga

SEQ ID NO: 61542 - RNA, 3023 nt, Artificial Sequence
  R4008
gggagaaagcuuaccauggccgugauggccccgcggacccugguccuccugcugagcggcgcgcucgcccugacccagacgugggccgggcaggugcagcucguccaguccggggccgaggugaaggagcccggcagcgccaugaagguguccugcaaggccagcgggggcacguucuccagcgacgccuucugcuggguccggcaggcgccggggcgcggccuggaguggaugggcgggaucauccccguguuccagaccgccaacuacggccccaacuuccaggggcgggugaccaucuccgccgacgucuacaccacgacccuguaccucgagcugagcggccugaccuccgaggacaccgccguguacuucugcgcgcgcagcggggacggcuacaacuacuacuucccccucuggggccaggggacgcuggugaccgucuccagcgccuccaccaagggcccgagcguguucccccuggcccccuccagcaaguccaccagcgggggcacggccgcccucggcugccuggugaaggacuacuuccccgagccggucaccguguccuggaacagcggggcgcugaccagcggcgugcacaccuuccccgccguccuccaguccagcgggcuguacucccugagcuccguggugacgguccccagcuccagccucggcacccagaccuacaucugcaacgugaaccacaagcccuccaacaccaagguggacaagaaggucgagcccaagagcugcgacaagacgcacaccugcccgcccugccccgccccggagcugcugggcgggcccuccguguuccucuucccgcccaagccgaaggacacccugaugaucagccggacccccgaggucacgugcgugguggucgacgugucccacgaggaccccgaggugaaguucaacugguacgucgacggcguggaggugcacaacgccaagaccaagccccgcgaggagcaguacaacagcaccuaccgggucguguccgugcugaccguccuccaccaggacuggcugaacgggaaggaguacaagugcaaggugagcaacaaggcccugccggcgcccaucgagaagacgaucuccaaggccaagggccagccccgcgagccccagguguacacccucccgcccagccgggacgagcugaccaagaaccaggucucccugaccugccucgugaagggguucuaccccagcgacaucgccguggagugggagagcaacggccagccggagaacaacuacaagacgaccccgcccguccuggacuccgacgggagcuucuuccuguacuccaagcucaccguggacaagagccgcuggcagcagggcaacguguucuccugcagcgucaugcacgaggcccugcacaaccacuacacccagaagucccugagccucucccccggcaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggacauccagaugacccagagccccuccacccucagcggcuccgucggggaccgggugacgaucaccugccgcgcgagccagaacaucggccccuggcuggccugguaccagcaggaguccgggaaggcccccaagcugcucaucagccgggccuccauccuggagagcggcgugcccucccgcuucagcggcaccgggaccggcacggaguucacccugaccaucuccagccuccagcccgacgacuucgccaccuacuacugccagcacuacaacgcguacugggggacguucggccaggggaccaaggucgagaucaaccggaccguggccgccccguccguguucaucuucccgccgagcgacgagcagcugaaguccggcaccgccagcgucgugugccugcucaacaacuucuacccccgcgaggcgaaggugcaguggaaggucgacaacgcccugcaguccggcaacagccaggaguccgugacggagcaggacagcaaggacagcaccuacucccugagcuccacccucacccugagcaaggccgacuacgagaagcacaagguguacgccugcgaggucacgcaccaggggcuguccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61543 - protein, 457 aa, Artificial Sequence
  Protein (HC) w/o signal peptide encoded by mRNA R4010
QVKLLESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61544 - protein, 212 aa, Artificial Sequence
  Protein (LC) w/o signal peptide encoded by mRNA R4010
ELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61545 - RNA, 1371 nt, Artificial Sequence
  CDS (HC) w/o signal peptide encoded by mRNA R4010
caggugaagcugcucgaguccggcgggggccuggugcagcccgggggcagccugcgccucuccugcgccgcgagcggcaucaccuucuccagcuacgccauguccuggguccggcaggccccggggaagggccuggagugggugagcaccgugaacuccgggggcgggagcacguacuacggcgacuccguccgcggccgguucaccaucagccgcgacaacuccaagagcacccuguaccuccagcugaacucccugcgggccgaggacaccgccaucuacuacugcgcgaaggacaaggggcgccccaucuucggccucgugacgcccagcuacuacauggacgugugggggaacggcaccaccgucaccguguccagcgccuccacgaagggccccagcguguucccgcuggcccccagcuccaagagcaccuccgggggcaccgccgcgcuggggugccucgucaaggacuacuuccccgagcccgugaccgugagcuggaacuccggcgcccugacgagcgggguccacaccuuccccgccgugcugcaguccagcggccucuacucccugagcuccguggucaccgugcccagcuccagccugggcacccagacguacaucugcaacgugaaccacaagcccuccaacaccaaggucgacaagaagguggagcccaagagcugcgacaagacccacaccugcccgcccugccccgccccggagcuccugggcgggccguccguguuccuguucccgcccaagcccaaggacacgcucaugaucagccggaccccggaggucaccugcguggucguggacgugucccacgaggaccccgaggucaaguucaacugguacguggacgggguggagguccacaacgccaagaccaagccccgcgaggagcaguacaacagcacguaccggguggugagcguccugaccgugcugcaccaggacuggcucaacggcaaggaguacaagugcaagguguccaacaaggcgcugcccgccccgaucgagaagaccaucagcaaggccaaggggcagccccgcgagccccaggucuacacccugcccccgucccgggacgagcucacgaagaaccaggugagccugaccugccuggugaagggcuucuaccccuccgacaucgccgucgagugggagagcaacggccagcccgagaacaacuacaagaccaccccgcccgugcucgacuccgacgggagcuucuuccuguacuccaagcugacgguggacaagagccgcuggcagcagggcaacgucuucuccugcagcgugaugcacgaggcccuccacaaccacuacacccagaagucccugagccugucccccgggaag

SEQ ID NO: 61546 - RNA, 636 nt, Artificial Sequence
  CDS (LC) w/o signal peptide encoded by mRNA R4010
gagcucacccagagccccuccagccuguccgcgagcgucggggacuccgugaccaucacgugccggaccagcgagcgcaucuccaccuaccugaacugguaccagcagaagcccgggaaggccccgcggcuccuggugagcggcgccuccacccugcagggcggcguccccagccgcuucuccgggagcggguccggcacggccuucacccucaccaucaacagccugcagccggaggacuucgccaccuacuacugccagcaguccuacagcacgccccugaccuucgggggcgggaccaagguggagaucaagcggaccguggcggcccccuccgucuucaucuucccgccgagcgacgagcagcucaaguccggcacggccagcguggugugccugcugaacaacuucuacccccgcgaggccaagguccaguggaagguggacaacgcgcuccagagcggcaacucccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugc

SEQ ID NO: 61547 - RNA, 1371 nt, Artificial Sequence
  derived and/or modified sequence opt2 from CDS (HC) w/o signal peptide encoded by mRNA R4010
caggucaagcuccucgaguccggcggcggccucguccagcccggcggcucccuccgccucuccugcgccgccuccggcaucaccuucuccuccuacgccauguccuggguccgccaggcccccggcaagggccucgagugggucuccaccgucaacuccggcggcggcuccaccuacuacggcgacuccguccgcggccgcuucaccaucucccgcgacaacuccaaguccacccucuaccuccagcucaacucccuccgcgccgaggacaccgccaucuacuacugcgccaaggacaagggccgccccaucuucggccucgucacccccuccuacuacauggacgucuggggcaacggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61548 - RNA, 636 nt, Artificial Sequence
  derived and/or modified sequence opt2 from CDS (LC) w/o signal peptide encoded by mRNA R4010
gagcucacccagucccccuccucccucuccgccuccgucggcgacuccgucaccaucaccugccgcaccuccgagcgcaucuccaccuaccucaacugguaccagcagaagcccggcaaggccccccgccuccucgucuccggcgccuccacccuccagggcggcguccccucccgcuucuccggcuccggcuccggcaccgccuucacccucaccaucaacucccuccagcccgaggacuucgccaccuacuacugccagcaguccuacuccaccccccucaccuucggcggcggcaccaaggucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61549 - RNA, 1371 nt, Artificial Sequence
  derived and/or modified sequence opt3 from CDS (HC) w/o signal peptide encoded by mRNA R4010
caggugaagcugcucgagagcggcgggggacuuguccaacccgguggcucccugagauugucuugcgccgcuucagggaucaccuucaguagcuacgcaauguccuggguuaggcaggccccuggaaaaggcuuagaaugggugucuacaguaaacucgggugggggaucaacuuauuacggcgacagcgugcggggccgcuuuacgauuagucgagauaauuccaagucuacccuguaucuacagcucaacagccugcgugcggaggacacagcuauauacuauugugccaaagauaaggggagaccaaucuucggacuugucacuccguccuacuauauggacgugugggguaauggcaccacaguuaccgugucaagugcaagcacuaaagggcccucugucuuuccucuggccccauccucaaagagcacaaguggaggcaccgcugcauuggguugccucgugaaggauuacuuccccgaaccuguaacgguuucuuggaacuccggggcccugacuagcggagugcacaccuuuccagcuguccugcagucgucuggccucuacuccuuaucaaguguggugacaguccccagcuccucucugggcacucaaaccuauauuuguaauguuaaccauaaaccuagcaauacaaagguggacaaaaagguagagccaaaaucaugcgauaagacccacacguguccgcccugcccugccccagaacuuuugggagggcccaguguguuccuguuuccuccaaagcccaaagacacucuaaugaucuccaggacaccggaggucaccugugugguuguggaugucagccaugaggacccugaagugaaguucaacugguacguagaugguguugaggugcacaaugcgaaaacuaagccccgggaggaacaguauaacucuacauaccgcgucgugucaguccucaccgugcugcaucaggacuggcuuaauggcaaagaguauaagugcaaaguuaguaacaaggcacugccagccccuauugaaaagacgaucagcaaagcuaaggggcagcccagagagccacaaguguacaccuugcccccuuccagggaugaacucacaaagaaucagguaucucugacuuguuuagucaagggauuuuauccaucggacauagccguggagugggaaagcaacggccagccggagaauaacuacaaaaccacacccccuguucuggacuccgaugguucauucuuucucuacaguaaacuuacuguggacaagucucgguggcagcaagggaacgucuucagcugcuccgugaugcacgaggcacugcacaaucauuauacccagaaaucauugagccuaucuccaggcaag

SEQ ID NO: 61550 - RNA, 636 nt, Artificial Sequence
  derived and/or modified sequence opt3 from CDS (LC) w/o signal peptide encoded by mRNA R4010
gagcugacccagagccccuccucucucucagccagugugggcgacagcgucacaaucacuugcagaacguccgaaaggauuucuaccuaccuuaacugguaucaacagaagccugggaaagcuccacggcuguugguuucgggagcaucaacauuacaggguggcgugccgagccgcuucaguggguccggaucuggcacugccuuuacccugacaauaaauagccuacagcccgaggauuucgcgaccuacuauugucaacaguccuacucaacuccucucacauuuggugggggaaccaagguagaaaucaaacgaacgguggcugccccaagugucuucauuuuucccccuagcgacgagcagcugaagucuggcacugcauccgugguuugccuucugaacaauuucuauccacgugaagccaaagugcaguggaaggucgauaacgcuuugcaaucaggcaauagccaggagagugugaccgagcaggacucuaaggauuccacauacagccucucgucuacucugacccuguccaaagcagacuaugaaaagcacaaaguauacgccugugagguuacacaucaggggcucucaagucccgugaccaagagcuuuaacagaggagaaugc

SEQ ID NO: 61551 - RNA, 1371 nt, Artificial Sequence
  derived and/or modified sequence opt4 from CDS (HC) w/o signal peptide encoded by mRNA R4010
caggugaagcugcuggagagcggcggcggccuggugcagcccggcggcagccugagacugagcugcgccgccagcggcaucaccuucagcagcuacgccaugagcugggugagacaggcccccggcaagggccuggagugggugagcaccgugaacagcggcggcggcagcaccuacuacggcgacagcgugagaggcagauucaccaucagcagagacaacagcaagagcacccuguaccugcagcugaacagccugagagccgaggacaccgccaucuacuacugcgccaaggacaagggcagacccaucuucggccuggugacccccagcuacuacauggacguguggggcaacggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61552 - RNA, 636 nt, Artificial Sequence
  derived and/or modified sequence opt4 from CDS (LC) w/o signal peptide encoded by mRNA R4010
gagcugacccagagccccagcagccugagcgccagcgugggcgacagcgugaccaucaccugcagaaccagcgagagaaucagcaccuaccugaacugguaccagcagaagcccggcaaggcccccagacugcuggugagcggcgccagcacccugcagggcggcgugcccagcagauucagcggcagcggcagcggcaccgccuucacccugaccaucaacagccugcagcccgaggacuucgccaccuacuacugccagcagagcuacagcaccccccugaccuucggcggcggcaccaagguggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61553 - RNA, 1371 nt, Artificial Sequence
  derived and/or modified sequence opt5 from CDS (HC) w/o signal peptide encoded by mRNA R4010
caggugaagcugcucgagagcggcgggggacugguccaacccggcgggucccuuagacugucuugcgccgcuagcggaaucaccuucuccucuuacgccaugagcuggguucggcaggcgccuggcaaagggcucgaauggguguccacagugaacucuggaggcggcagcacguauuacggggacuccguccgcggaagauuuaccauuagccgggauaauucuaaguccacacuguaucuucagcugaacagccuccgcgcugaggacaccgccaucuacuauugugccaaagauaagggcagaccgauuuucgggcuggugacacccucuuacuauauggacguuuggggaaauggcaccacagugaccgucuccagcgcuucuacgaaagggccuuccguguuuccccuggccccuagcuccaagucuaccagcggaggcacagcugcccucggcugccugguuaaggauuacuuccccgaaccugugaccgucuccuggaacagcggggcgcuuacaucuggagugcacaccuuuccggccgugcugcaguccagcggccucuacucucugagcuccgucguuacggugcccucuagcucccuugggacacaaaccuauaucuguaaugugaaccauaaaccuagcaauacaaaggucgacaaaaagguggagcccaaaucuugcgauaagacccacaccuguccucccugcccggcuccugaacugcucggaggccccuccguuuuccuguuuccucccaagcccaaagacacacugaugauuagccggacgccugaggugaccugugucgugguugaugugucucaugaggacccggaagucaaguucaacugguacguggauggggucgaggugcacaaugccaaaacaaagccccgcgaggaacaguauaacuccaccuacagaguugugagcguccucacagugcugcaucaggacuggcuuaauggaaaagaguauaagugcaaaguuuccaacaaggcucugccugcccccaucgaaaagaccaucucuaaagcgaagggccagccucgggagccccaaguguacacgcucccgccuagccgcgaugaacugaccaaaaaucaggucucccuuacaugucuggugaagggcuuuuaucccucugacauugccguggagugggaaagcaacgggcagccugagaauaacuacaaaaccacacccccuguucucgacuccgauggcagcuucuuucuguacucuaagcugaccgucgacaaguccagauggcagcaaggaaacguguucagcugcucugugaugcacgaggcucuccacaaucauuauacacagaaaucccugagccuuucucccgggaag

SEQ ID NO: 61554 - RNA, 636 nt, Artificial Sequence
  derived and/or modified sequence opt5 from CDS (LC) w/o signal peptide encoded by mRNA R4010
gagcugacccagagccccuccucucucagcgccuccgugggcgacucugucacaaucacgugcagaaccagcgaacggauuuccacauaccugaacugguaucaacagaagccugggaaagcuccgcgccuucugguuucuggagccagcacccuccagggcggggugcccuccagauucagcggaucuggcuccgggacagcguuuacccugacaaucaauagccuucagccugaggauuucgcuaccuacuauugucaacagucuuacuccacgccccugaccuuuggaggcggcacaaagguggaaauuaaacggaccgucgccgccccuagcguguucaucuuucccccuucugacgagcagcucaaguccgggacagcuagcguugugugccugcugaacaauuucuauccgcgcgaagccaaaguccaguggaagguggauaacgcucuccaauccggaaauucucaggagagcguuaccgagcaggacuccaaggauagcacguacucucuguccagcacacuuacccugucuaaagccgacuaugaaaagcacaaaguguacgcgugugaggucacacaucagggccucagcucccccgugaccaagucuuuuaacagaggggaaugc

SEQ ID NO: 61555 - RNA, 1371 nt, Artificial Sequence
  derived and/or modified sequence opt6 from CDS (HC) w/o signal peptide encoded by mRNA R4010
caagucaaacuauuagaaucuggaggcggacuuguacaaccaggcgggagccuaagacuuucaugugcagcaucugguauaacauucucaucauacgcaaugucauggguacgacaagcaccaggaaaaggauuagaauggguaucaacaguaaauagcggaggcgguucaacuuacuauggagacucaguacguggcagauucacaauaucaagagauaacucuaaaucaacauuauaucuacaauuaaauucacuaagagcagaagacaccgcuauauacuauugugccaaagacaaaggaagaccaauauucggacuaguaacaccaucuuacuacauggauguauggggaaauggaacaacuguaacagucucaagcgcaucaacaaaaggaccaucaguauuuccucuagcaccauccucaaaaucaacauccggaggaacagcagcucuaggaugccucguaaaagacuacuuuccagaaccaguaaccguaucauggaacucaggagcucuaacaucagguguccacaccuuuccugccguacuucaaucaucaggauuauauucacuaagcucaguaguuaccguaccaaguuccagucuaggaacucaaaccuacauaugcaacguuaaccacaaaccuucaaauacaaaaguagacaaaaaaguagaaccaaaaucuugcgacaaaacacacacauguccaccaugcccagccccagaauuacuaggaggcccaucaguauucuuauucccuccaaaaccaaaagacacauuaaugauaucuagaacaccagaaguaacaugcguuguuguagacguaucacaugaagauccagaaguaaaauucaacugguauguagauggaguagaaguacacaaugccaaaacuaaaccaagagaagaacaauauaacucuacauaccgagucguuucaguacuaacaguacuccaucaagacuggcucaauggaaaagaauacaaaugcaaaguaucaaacaaagccuuaccagcaccaauagaaaaaaccauuucaaaagcaaaaggacaaccuagagaaccacaaguauacacacuucccccaucaagagacgaauuaacuaaaaaccaaguaagccuuacaugccucgucaaaggauuuuacccaagcgacauagcaguagaaugggaaucaaauggacaaccagaaaacaacuauaaaacaacacccccaguucuagauuccgacggaucuuucuuccucuacucaaaacuaacaguugacaaaucaagauggcaacaaggaaacguuuucucaugcucaguuaugcacgaagcacuacauaaucauuauacucaaaaaucacuaucacuaucaccuggaaaa

SEQ ID NO: 61556 - RNA, 636 nt, Artificial Sequence
  derived and/or modified sequence opt6 from CDS (LC) w/o signal peptide encoded by mRNA R4010
gaacucacacaaagcccaucaucauuaucagcaucaguaggagacucaguaacaauaacauguagaacaucagaaagaauaucaacauaccuaaauugguaccaacaaaaaccaggaaaagcaccaagacuccuaguaucaggagcaagcacacuacaaggaggaguaccaucaagauucucaggaucaggauccggaacagcauucacacuaacaaucaacucacuacaaccagaagacuucgcaacauacuacugucaacaaucauacucaacaccacuaacauucggcggaggaacaaaaguagaaauaaaaagaacaguagcagcaccaucaguauucauauucccaccaucagacgaacaacuaaaaucaggcacagcaucaguaguaugccuacuaaacaacuucuacccaagagaagcaaaaguacaauggaaaguagacaacgcacuacaaucaggaaacucacaagaaucagucacagaacaagacuccaaagacucaacauacucccuaucaucaacacuaacccuaucaaaagcagacuacgaaaaacauaaaguauacgcaugcgaaguaacacaccaaggacuaucaucaccaguaacaaaaucauucaacagaggagaaugc

SEQ ID NO: 61557 - RNA, 1371 nt, Artificial Sequence
  derived and/or modified sequence opt11 from CDS (HC) w/o signal peptide encoded by mRNA R4010
caagucaaacuacuagagucaggcggcggccuaguccaacccggcggcucacuccgacucagcugcgccgccagcggaaucaccuucucaucauacgccauguccuggguccgacaagcccccgggaaaggccuagaaugggucuccaccgugaacaguggcggaggcuccacuuacuacggcgacuccguccgcggccgauucaccauuucacgcgacaacuccaaaagcacccuauaccuccaacuaaauagccuccgcgccgaagauacugcaauauacuacugcgccaaagacaaaggccgacccaucuucggccucgucacacccuccuacuacauggacgucuggggaaacggaaccaccgucaccguaucauccgccucaacaaaaggcccauccgucuucccacuagcaccaagcagcaaaucuaccucaggcggcaccgccgcacucggcugucucguaaaagacuacuuucccgaaccaguaaccguaucauggaacuccggcgcccuaaccuccggaguccacaccuuccccgccguccuacaauccucaggacucuacucccuaaguucagucgugaccguccccuccuccagccuuggcacccaaaccuacaucugcaacgugaaucacaaacccuccaacaccaaagucgauaagaaagucgaaccuaaauccugcgacaaaacacacaccuguccacccugccccgcgcccgagcuccuuggaggccccagcgucuuccuauucccucccaaacccaaagacacccucaugauaucccgcacacccgaaguaaccugcgucgucgucgacguaucacacgaagacccagaaguaaaauucaacugguacgucgacggagucgaaguccacaacgccaaaaccaaaccacgagaagaacaauacaauucaacguauagagucgucucaguccuuacaguccuccaucaagacuggcucaacggaaaagaauacaaaugcaaagucuccaacaaagcccuacccgcccccaucgagaaaaccaucucaaaagcaaaaggccaacccagagaaccccaagucuacacacuaccacccucacgcgacgaacucacuaaaaaccaagucucacugaccugccucguaaaaggcuuuuaccccuccgacaucgcaguagaaugggaaucaaacggccaacccgaaaacaacuacaagaccaccccacccguacucgacucugacggauccuucuuccucuacuccaaacucaccgucgacaaaucccgcuggcaacaaggcaacgucuucuccugcagcgucaugcacgaagcucuccacaaccacuacacacaaaaaucacucucacuaucccccggcaag

SEQ ID NO: 61558 - RNA, 636 nt, Artificial Sequence
  derived and/or modified sequence opt11 from CDS (LC) w/o signal peptide encoded by mRNA R4010
gaacucacccaaucaccaucaucccucuccgccucagucggcgacuccgucacaauaaccugccgcaccuccgaacgaaucuccacauaccucaacugguaccaacaaaaacccggcaaagcccccagacuccuagucuccggcgccucaacccuccaaggcggcguccccucccgauucuccggcuccggcuccggcaccgccuucacccucaccaucaacucccuacaacccgaagacuucgccaccuacuacugccaacaauccuauucaacaccccucaccuucggcggaggaaccaaagucgaaaucaaacgcaccgucgccgcccccuccgucuucauauucccacccuccgacgaacaacucaaauccggcaccgccucagucgucugccuccucaacaacuucuacccccgcgaagccaaaguccaauggaaaguugacaacgcccuccaaucaggaaacucccaagaauccgucaccgaacaagacagcaaagacuccaccuacucccucuccuccacccugacccucuccaaagccgacuacgaaaaacacaaagucuacgccugcgaagucacccaccaaggccuaagcucccccgucaccaagagcuucaaccgcggcgaaugc

SEQ ID NO: 61559 - protein, 482 aa, Artificial Sequence
  Protein (HC) encoded by mRNA R4010
MAVMAPRTLVLLLSGALALTQTWAGQVKLLESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61560 - protein, 237 aa, Artificial Sequence
  Protein (LC) encoded by mRNA R4010
MAVMAPRTLVLLLSGALALTQTWAGELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61561 - RNA, 1449 nt, Artificial Sequence
  CDS (HC) encoded by mRNA R4010
auggccgugauggccccgcggacccugguccuccugcugagcggcgcgcucgcccugacccagacgugggccgggcaggugaagcugcucgaguccggcgggggccuggugcagcccgggggcagccugcgccucuccugcgccgcgagcggcaucaccuucuccagcuacgccauguccuggguccggcaggccccggggaagggccuggagugggugagcaccgugaacuccgggggcgggagcacguacuacggcgacuccguccgcggccgguucaccaucagccgcgacaacuccaagagcacccuguaccuccagcugaacucccugcgggccgaggacaccgccaucuacuacugcgcgaaggacaaggggcgccccaucuucggccucgugacgcccagcuacuacauggacgugugggggaacggcaccaccgucaccguguccagcgccuccacgaagggccccagcguguucccgcuggcccccagcuccaagagcaccuccgggggcaccgccgcgcuggggugccucgucaaggacuacuuccccgagcccgugaccgugagcuggaacuccggcgcccugacgagcgggguccacaccuuccccgccgugcugcaguccagcggccucuacucccugagcuccguggucaccgugcccagcuccagccugggcacccagacguacaucugcaacgugaaccacaagcccuccaacaccaaggucgacaagaagguggagcccaagagcugcgacaagacccacaccugcccgcccugccccgccccggagcuccugggcgggccguccguguuccuguucccgcccaagcccaaggacacgcucaugaucagccggaccccggaggucaccugcguggucguggacgugucccacgaggaccccgaggucaaguucaacugguacguggacgggguggagguccacaacgccaagaccaagccccgcgaggagcaguacaacagcacguaccggguggugagcguccugaccgugcugcaccaggacuggcucaacggcaaggaguacaagugcaagguguccaacaaggcgcugcccgccccgaucgagaagaccaucagcaaggccaaggggcagccccgcgagccccaggucuacacccugcccccgucccgggacgagcucacgaagaaccaggugagccugaccugccuggugaagggcuucuaccccuccgacaucgccgucgagugggagagcaacggccagcccgagaacaacuacaagaccaccccgcccgugcucgacuccgacgggagcuucuuccuguacuccaagcugacgguggacaagagccgcuggcagcagggcaacgucuucuccugcagcgugaugcacgaggcccuccacaaccacuacacccagaagucccugagccugucccccgggaaguga

SEQ ID NO: 61562 - RNA, 714 nt, Artificial Sequence
  CDS (LC) encoded by mRNA R4010
auggccgugauggccccgcggacccugguccuccugcugagcggcgcgcucgcccugacccagacgugggccggggagcucacccagagccccuccagccuguccgcgagcgucggggacuccgugaccaucacgugccggaccagcgagcgcaucuccaccuaccugaacugguaccagcagaagcccgggaaggccccgcggcuccuggugagcggcgccuccacccugcagggcggcguccccagccgcuucuccgggagcggguccggcacggccuucacccucaccaucaacagccugcagccggaggacuucgccaccuacuacugccagcaguccuacagcacgccccugaccuucgggggcgggaccaagguggagaucaagcggaccguggcggcccccuccgucuucaucuucccgccgagcgacgagcagcucaaguccggcacggccagcguggugugccugcugaacaacuucuacccccgcgaggccaagguccaguggaagguggacaacgcgcuccagagcggcaacucccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugcuga

SEQ ID NO: 61563 - RNA, 2834 nt, Artificial Sequence
  CDS (HC)-IRES-CDS (LC) as RNA from mRNA R4010
auggccgugauggccccgcggacccugguccuccugcugagcggcgcgcucgcccugacccagacgugggccgggcaggugaagcugcucgaguccggcgggggccuggugcagcccgggggcagccugcgccucuccugcgccgcgagcggcaucaccuucuccagcuacgccauguccuggguccggcaggccccggggaagggccuggagugggugagcaccgugaacuccgggggcgggagcacguacuacggcgacuccguccgcggccgguucaccaucagccgcgacaacuccaagagcacccuguaccuccagcugaacucccugcgggccgaggacaccgccaucuacuacugcgcgaaggacaaggggcgccccaucuucggccucgugacgcccagcuacuacauggacgugugggggaacggcaccaccgucaccguguccagcgccuccacgaagggccccagcguguucccgcuggcccccagcuccaagagcaccuccgggggcaccgccgcgcuggggugccucgucaaggacuacuuccccgagcccgugaccgugagcuggaacuccggcgcccugacgagcgggguccacaccuuccccgccgugcugcaguccagcggccucuacucccugagcuccguggucaccgugcccagcuccagccugggcacccagacguacaucugcaacgugaaccacaagcccuccaacaccaaggucgacaagaagguggagcccaagagcugcgacaagacccacaccugcccgcccugccccgccccggagcuccugggcgggccguccguguuccuguucccgcccaagcccaaggacacgcucaugaucagccggaccccggaggucaccugcguggucguggacgugucccacgaggaccccgaggucaaguucaacugguacguggacgggguggagguccacaacgccaagaccaagccccgcgaggagcaguacaacagcacguaccggguggugagcguccugaccgugcugcaccaggacuggcucaacggcaaggaguacaagugcaagguguccaacaaggcgcugcccgccccgaucgagaagaccaucagcaaggccaaggggcagccccgcgagccccaggucuacacccugcccccgucccgggacgagcucacgaagaaccaggugagccugaccugccuggugaagggcuucuaccccuccgacaucgccgucgagugggagagcaacggccagcccgagaacaacuacaagaccaccccgcccgugcucgacuccgacgggagcuucuuccuguacuccaagcugacgguggacaagagccgcuggcagcagggcaacgucuucuccugcagcgugaugcacgaggcccuccacaaccacuacacccagaagucccugagccugucccccgggaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggagcucacccagagccccuccagccuguccgcgagcgucggggacuccgugaccaucacgugccggaccagcgagcgcaucuccaccuaccugaacugguaccagcagaagcccgggaaggccccgcggcuccuggugagcggcgccuccacccugcagggcggcguccccagccgcuucuccgggagcggguccggcacggccuucacccucaccaucaacagccugcagccggaggacuucgccaccuacuacugccagcaguccuacagcacgccccugaccuucgggggcgggaccaagguggagaucaagcggaccguggcggcccccuccgucuucaucuucccgccgagcgacgagcagcucaaguccggcacggccagcguggugugccugcugaacaacuucuacccccgcgaggccaagguccaguggaagguggacaacgcgcuccagagcggcaacucccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugcuga

SEQ ID NO: 61564 - RNA, 3026 nt, Artificial Sequence
  R4010
gggagaaagcuuaccauggccgugauggccccgcggacccugguccuccugcugagcggcgcgcucgcccugacccagacgugggccgggcaggugaagcugcucgaguccggcgggggccuggugcagcccgggggcagccugcgccucuccugcgccgcgagcggcaucaccuucuccagcuacgccauguccuggguccggcaggccccggggaagggccuggagugggugagcaccgugaacuccgggggcgggagcacguacuacggcgacuccguccgcggccgguucaccaucagccgcgacaacuccaagagcacccuguaccuccagcugaacucccugcgggccgaggacaccgccaucuacuacugcgcgaaggacaaggggcgccccaucuucggccucgugacgcccagcuacuacauggacgugugggggaacggcaccaccgucaccguguccagcgccuccacgaagggccccagcguguucccgcuggcccccagcuccaagagcaccuccgggggcaccgccgcgcuggggugccucgucaaggacuacuuccccgagcccgugaccgugagcuggaacuccggcgcccugacgagcgggguccacaccuuccccgccgugcugcaguccagcggccucuacucccugagcuccguggucaccgugcccagcuccagccugggcacccagacguacaucugcaacgugaaccacaagcccuccaacaccaaggucgacaagaagguggagcccaagagcugcgacaagacccacaccugcccgcccugccccgccccggagcuccugggcgggccguccguguuccuguucccgcccaagcccaaggacacgcucaugaucagccggaccccggaggucaccugcguggucguggacgugucccacgaggaccccgaggucaaguucaacugguacguggacgggguggagguccacaacgccaagaccaagccccgcgaggagcaguacaacagcacguaccggguggugagcguccugaccgugcugcaccaggacuggcucaacggcaaggaguacaagugcaagguguccaacaaggcgcugcccgccccgaucgagaagaccaucagcaaggccaaggggcagccccgcgagccccaggucuacacccugcccccgucccgggacgagcucacgaagaaccaggugagccugaccugccuggugaagggcuucuaccccuccgacaucgccgucgagugggagagcaacggccagcccgagaacaacuacaagaccaccccgcccgugcucgacuccgacgggagcuucuuccuguacuccaagcugacgguggacaagagccgcuggcagcagggcaacgucuucuccugcagcgugaugcacgaggcccuccacaaccacuacacccagaagucccugagccugucccccgggaagugauugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggagcucacccagagccccuccagccuguccgcgagcgucggggacuccgugaccaucacgugccggaccagcgagcgcaucuccaccuaccugaacugguaccagcagaagcccgggaaggccccgcggcuccuggugagcggcgccuccacccugcagggcggcguccccagccgcuucuccgggagcggguccggcacggccuucacccucaccaucaacagccugcagccggaggacuucgccaccuacuacugccagcaguccuacagcacgccccugaccuucgggggcgggaccaagguggagaucaagcggaccguggcggcccccuccgucuucaucuucccgccgagcgacgagcagcucaaguccggcacggccagcguggugugccugcugaacaacuucuacccccgcgaggccaagguccaguggaagguggacaacgcgcuccagagcggcaacucccaggagagcgugaccgagcaggacuccaaggacagcaccuacucccugagcuccacccugacgcucagcaaggccgacuacgagaagcacaaggucuacgccugcgaggugacccaccaggggcuguccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61565 - protein, 448 aa, Artificial Sequence; identical to SEQ ID NO: 484
  Protein (HC) w/o signal peptide encoded by mRNA R5417

SEQ ID NO: 61566 - RNA, 1344 nt, Artificial Sequence; identical to SEQ ID NO: 8126
  CDS (HC) w/o signal peptide encoded by mRNA R5417

SEQ ID NO: 61567 - RNA, 1344 nt, Artificial Sequence; identical to SEQ ID NO: 15768
  derived and/or modified sequence opt2 from CDS (HC) w/o signal peptide encoded by mRNA R5417

SEQ ID NO: 61568 - RNA, 1344 nt, Artificial Sequence; identical to SEQ ID NO: 23410
  derived and/or modified sequence opt3 from CDS (HC) w/o signal peptide encoded by mRNA R5417

SEQ ID NO: 61569 - RNA, 1344 nt, Artificial Sequence; identical to SEQ ID NO: 31052
  derived and/or modified sequence opt4 from CDS (HC) w/o signal peptide encoded by mRNA R5417

SEQ ID NO: 61570 - RNA, 1344 nt, Artificial Sequence; identical to SEQ ID NO: 38694
  derived and/or modified sequence opt5 from CDS (HC) w/o signal peptide encoded by mRNA R5417

SEQ ID NO: 61571 - RNA, 1344 nt, Artificial Sequence
  derived and/or modified sequence opt6 from CDS (HC) w/o signal peptide encoded by mRNA R5417
caaguucaacuaguagaaucaggaggaggagucguccaaccaggcagaucacuaagacuaucaugugcagccucuggcuucacauucucuucuuauacaaugcacuggguaagacaagcaccaggaaaaggacuagaauggguaacauucauaucuuacgacggaaauaacaaauauuacgcugauucuguaaaagguagauucacaauuucuagagacaauaguaaaaauacauuauaccuccaaaugaauagucuuagagcagaagauacagcaauauacuauugugcacgaacaggaugguuaggaccauucgauuacuggggucaaggaacauuaguaacaguaucaucugcaucaacaaaagguccuucaguauucccacucgcaccaucaucaaaauccacaucaggaggaacugcagcccucggaugccuagucaaagacuacuucccagaaccaguaaccguaucuuggaacuccggagcauuaacaucuggaguacauacauucccugcaguacuccaaucaucaggacuauacucacuauccuccguaguaaccgucccuucaucaucucuagguacacaaacuuacauaugcaacguaaaucacaaaccaucuaauacaaaaguagacaaaagagucgaaccaaaaucaugcgacaaaacccacacaugccccccaugcccagcacccgaacuacucggaggaccaucaguauuucuauuuccaccaaaaccaaaagauacacuaaugauaucacgaacaccugaaguaaccuguguugucgucgacguaucgcacgaagacccagaaguaaaauuuaauugguacguagacgguguagaaguucacaaugcaaaaacaaaaccaagagaagaacaauacaacucaacauauagaguaguuucugucuuaaccgucuuacaccaagauugguuaaacgguaaagaauauaaaugcaaaguaucuaauaaagcucuacccgccccaaucgaaaaaacaauaucaaaagccaaaggccaaccucgagaaccacaaguauacacacuacccccuucaagagaugaacuaacaaaaaaccaaguaagccuaacaugccuaguaaaaggcuuuuauccaucagacauagcaguagaaugggaaucuaacggucaaccugaaaauaacuauaaaacaacaccaccaguacuagacucagauggaucauucuuucuauacucaaaauuaacaguagauaaaucaagauggcaacaaggaaacguuuuuucuuguucuguaaugcacgaagcacuacacaaucacuauacccaaaaaucucucagccuaucacccggaaaa

SEQ ID NO: 61572 - RNA, 1344 nt, Artificial Sequence
  derived and/or modified sequence opt11 from CDS (HC) w/o signal peptide encoded by mRNA R5417
caaguucaacucguagaaucaggaggaggcgucguccaaccaggccgcucccuccgccuauccugcgccgcauccggcuucacuuucuccagcuacaccaugcacuggguccgacaggcccccggaaaaggccucgaaugggucacauucaucagcuacgacggaaacaacaaauacuacgccgacuccgucaaaggccgcuucaccaucucucgugacaacagcaaaaacacccucuaccuccaaaugaacucccuccgcgccgaagacacugcaaucuacuacugugcacgcacuggcuggcucggccccuucgacuacuggggccaaggcacacucgucaccgucuccucagccuccaccaaaggccccuccgucuucccccuggcacccuccucaaaaucuacauccggaggaaccgcagcccuuggcugccucguaaaagacuauuucccagaacccguaacagucuccuggaacagcggcgcgcucaccuccggcguccacaccuuccccgccguccuccaaucauccggccucuacucacucuccuccguaguaaccguucccucgucgucucucggaacccaaaccuacauaugcaacgucaaccauaaaccauccaacacaaagguagauaaaagagucgaaccuaaauccugcgacaagacccauaccugcccacccugcccggccccagaacuucucggcggccccucaguauuccucuuucccccgaaacccaaagacacacuaaugaucuccagaacacccgaaguaaccugcgucgucguagacgucucacacgaagacccagaagucaaauucaacugguacguagacggcgucgaaguacacaacgccaagacaaaaccccgcgaagaacaauacaacuccaccuaucgcgucgucagcguccuuaccguacuccaccaagacuggcucaacggcaaagaauacaaaugcaaaguaucaaacaaagcacuccccgccccuauugagaaaaccaucuccaaagcgaaaggccaaccccgagaaccccaaguauauacacuaccacccucacgcgacgaacucaccaaaaaccaagugucccuaaccugccucgucaagggcuucuaccccuccgacaucgccguagaaugggaauccaacggccagccagaaaacaacuacaaaaccaccccucccguacuagacuccgacggaucauucuuccuguacuccaaacucaccgucgacaaaucccgauggcaacaaggcaacguauucucaugcuccgucaugcacgaagcccuacacaaccacuacacccaaaagucccucucccucucacccggcaaa

SEQ ID NO: 61573 - protein, 467 aa, Artificial Sequence
  Protein (HC) encoded by mRNA R5417
MELGLSWIFLLAILKGVQCQVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61574 - RNA, 1404 nt, Artificial Sequence
  CDS (HC) encoded by mRNA R5417
auggagcugggccucagcuggaucuuccugcuggccauccucaagggggugcagugccaggugcagcuggucgagagcggcgggggcguggugcagcccgggcgcucccuccggcugagcugcgccgccuccggcuucaccuucagcuccuacaccaugcacuggguccgccaggcgccggggaagggccuggagugggugacguucaucagcuacgacggcaacaacaaguacuacgccgacuccgugaaggggcgguucaccaucagccgcgacaacuccaagaacacccucuaccugcagaugaacagccugcgggccgaggacaccgccaucuacuacugcgcccgcacgggcuggcucgggcccuucgacuacuggggccaggggacccuggucaccguguccagcgcguccaccaagggccccagcguguucccccuggccccguccagcaaguccacgagcggcgggaccgccgcccucggcugccuggucaaggacuacuuccccgagcccgugaccguguccuggaacagcggggcgcugaccagcggcguccacacguuccccgccgugcuccaguccagcggccuguacucccugagcuccguggucaccgugccgagcuccagccucgggacccagaccuacaucugcaacgugaaccacaagcccuccaacacgaaggucgacaagcggguggagcccaagagcugcgacaagacccacacgugcccgcccugccccgcccccgagcugcugggcgggcccuccguguuccucuucccgcccaagcccaaggacacccugaugaucagccgcacccccgaggugaccugcgucguggucgacgugucccacgaggacccggaggucaaguucaacugguacguggacggcguggagguccacaacgccaagaccaagccccgggaggagcaguacaacagcaccuaccgcgugguguccguccugacggugcuccaccaggacuggcugaacgggaaggaguacaagugcaaggugagcaacaaggcccugcccgcgcccaucgagaagaccaucuccaaggccaagggccagccgcgggagccccaggucuacacccucccgcccagccgcgacgagcugaccaagaaccaggugucccugacgugccucgugaagggcuucuaccccagcgacaucgccgucgagugggagagcaacgggcagcccgagaacaacuacaagaccacgcccccggugcuggacuccgacggcagcuucuuccuguacuccaagcucaccguggacaagagccgguggcagcaggggaacgucuucuccugcagcgugaugcacgaggcccugcacaaccacuacacccagaagucccugagccucucccccggcaaguga

SEQ ID NO: 61575 - RNA, 1621 nt, Artificial Sequence
  R5417
gggagaaagcuuaccauggagcugggccucagcuggaucuuccugcuggccauccucaagggggugcagugccaggugcagcuggucgagagcggcgggggcguggugcagcccgggcgcucccuccggcugagcugcgccgccuccggcuucaccuucagcuccuacaccaugcacuggguccgccaggcgccggggaagggccuggagugggugacguucaucagcuacgacggcaacaacaaguacuacgccgacuccgugaaggggcgguucaccaucagccgcgacaacuccaagaacacccucuaccugcagaugaacagccugcgggccgaggacaccgccaucuacuacugcgcccgcacgggcuggcucgggcccuucgacuacuggggccaggggacccuggucaccguguccagcgcguccaccaagggccccagcguguucccccuggccccguccagcaaguccacgagcggcgggaccgccgcccucggcugccuggucaaggacuacuuccccgagcccgugaccguguccuggaacagcggggcgcugaccagcggcguccacacguuccccgccgugcuccaguccagcggccuguacucccugagcuccguggucaccgugccgagcuccagccucgggacccagaccuacaucugcaacgugaaccacaagcccuccaacacgaaggucgacaagcggguggagcccaagagcugcgacaagacccacacgugcccgcccugccccgcccccgagcugcugggcgggcccuccguguuccucuucccgcccaagcccaaggacacccugaugaucagccgcacccccgaggugaccugcgucguggucgacgugucccacgaggacccggaggucaaguucaacugguacguggacggcguggagguccacaacgccaagaccaagccccgggaggagcaguacaacagcaccuaccgcgugguguccguccugacggugcuccaccaggacuggcugaacgggaaggaguacaagugcaaggugagcaacaaggcccugcccgcgcccaucgagaagaccaucuccaaggccaagggccagccgcgggagccccaggucuacacccucccgcccagccgcgacgagcugaccaagaaccaggugucccugacgugccucgugaagggcuucuaccccagcgacaucgccgucgagugggagagcaacgggcagcccgagaacaacuacaagaccacgcccccggugcuggacuccgacggcagcuucuuccuguacuccaagcucaccguggacaagagccgguggcagcaggggaacgucuucuccugcagcgugaugcacgaggcccugcacaaccacuacacccagaagucccugagccucucccccggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61576 - protein, 215 aa, Artificial Sequence; identical to SEQ ID NO: 485
  Protein (LC) w/o signal peptide encoded by mRNA R5418

SEQ ID NO: 61577 - RNA, 645 nt, Artificial Sequence; identical to SEQ ID NO: 8127
  CDS (LC) w/o signal peptide encoded by mRNA R5418

SEQ ID NO: 61578 - RNA, 645 nt, Artificial Sequence; identical to SEQ ID NO: 15769
  derived and/or modified sequence opt2 from CDS (LC) w/o signal peptide encoded by mRNA R5418

SEQ ID NO: 61579 - RNA, 645 nt, Artificial Sequence; identical to SEQ ID NO: 23411
  derived and/or modified sequence opt3 from CDS (LC) w/o signal peptide encoded by mRNA R5418

SEQ ID NO: 61580 - RNA, 645 nt, Artificial Sequence; identical to SEQ ID NO: 31053
  derived and/or modified sequence opt4 from CDS (LC) w/o signal peptide encoded by mRNA R5418

SEQ ID NO: 61581 - RNA, 645 nt, Artificial Sequence; identical to SEQ ID NO: 38695
  derived and/or modified sequence opt5 from CDS (LC) w/o signal peptide encoded by mRNA R5418

SEQ ID NO: 61582 - RNA, 645 nt, Artificial Sequence
  derived and/or modified sequence opt6 from CDS (LC) w/o signal peptide encoded by mRNA R5418
gaaauaguacuaacacaaucaccaggaacccucucacuaucuccaggagaaagagcaacacuaagcugcagagccucacaaucagucggaucaucauaccuagcaugguaccaacaaaaaccaggacaagcccccagauuacuaaucuacggagcauucucacgagcaacaggaaucccagacagauucucagguuccggaucaggaacagacuucacacuaacaauauccagauuagaaccagaagacuucgcaguauacuacugccaacaauacggaucaucaccauggacauuuggacaaggaaccaaaguagaaaucaaaagaacaguagcagccccaucaguauuuauauucccaccaucagacgaacaacuaaaaucaggcaccgcaucaguaguaugucuauuaaacaacuucuacccaagagaagcaaaaguacaauggaaaguagacaacgcacuacaaucaggaaacucccaagaaucagucacagaacaagacucaaaagacucaacauacucacuaucaucaacacuaaccuuaucaaaagcagacuacgaaaaacacaaaguauacgcaugcgaaguaacacaccaaggauuaucauccccaguaacaaaaucauucaacagaggagaaugc

SEQ ID NO: 61583 - RNA, 645 nt, Artificial Sequence
  derived and/or modified sequence opt11 from CDS (LC) w/o signal peptide encoded by mRNA R5418
gaaaucguccucacccaaucccccggcacacuaucccucucccccggcgaacgcgccacccucuccugccgcgccucccaauccgucggcuccuccuaccucgccugguaccaacaaaaacccggccaagccccccgucucuuaaucuacggcgccuucucccgcgccaccggaauccccgaccgauucuccggcuccggcuccggcacagacuucacccuaaccaucagccgccucgaacccgaagacuucgccgucuacuacugccaacaauacggauccucacccuggaccuucggccaaggcaccaaagucgaaaucaagcgcaccgucgccgcccccucuguauucauauuccccccauccgacgaacaacuaaaauccggcaccgccucagucgucugccuccucaacaacuucuacccccgcgaagccaaaguccaauggaaagucgacaacgcccuccaguccggcaacucccaagaaucagucaccgaacaagacucuaaagacucaacauacucccucuccuccacccuaacccucucaaaagccgacuacgaaaaacacaaagucuacgccugcgaagucacccaccaaggccucucaucccccgucaccaaauccuucaaccgaggcgaaugc

SEQ ID NO: 61584 - protein, 235 aa, Artificial Sequence
  Protein (LC) encoded by mRNA R5418
METPAQLLFLLLLWLPDTTGEIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61585 - RNA, 708 nt, Artificial Sequence
  CDS (LC) encoded by mRNA R5418
auggagacccccgcccagcugcucuuccugcugcuccuguggcugccggacaccacgggcgagaucgugcugacccagagccccggcacccucucccugagcccgggggagcgcgccacgcuguccugccgggccagccaguccgucggcagcuccuaccucgcgugguaccagcagaagcccgggcaggcgccccgccugcugaucuacggcgccuucagccgggccaccgggauccccgaccgcuucuccggcagcggcuccgggaccgacuucacccucacgaucagccggcuggagccggaggacuucgccguguacuacugccagcaguacggcuccagccccuggaccuucgggcagggcaccaagguggagaucaagcgcaccgucgccgcccccuccguguucaucuucccgcccagcgacgagcagcugaaguccgggacggccagcguggucugccuccugaacaacuucuacccccgggaggccaaggugcaguggaagguggacaacgcgcugcaguccggcaacagccaggagagcgucaccgagcaggacuccaaggacagcaccuacucccucagcuccacccugacgcugagcaaggccgacuacgagaagcacaagguguacgccugcgaggugacccaccagggccucuccagccccgucaccaaguccuucaaccgcggggagugcuga

SEQ ID NO: 61586 - RNA, 925 nt, Artificial Sequence
  R5418
gggagaaagcuuaccauggagacccccgcccagcugcucuuccugcugcuccuguggcugccggacaccacgggcgagaucgugcugacccagagccccggcacccucucccugagcccgggggagcgcgccacgcuguccugccgggccagccaguccgucggcagcuccuaccucgcgugguaccagcagaagcccgggcaggcgccccgccugcugaucuacggcgccuucagccgggccaccgggauccccgaccgcuucuccggcagcggcuccgggaccgacuucacccucacgaucagccggcuggagccggaggacuucgccguguacuacugccagcaguacggcuccagccccuggaccuucgggcagggcaccaagguggagaucaagcgcaccgucgccgcccccuccguguucaucuucccgcccagcgacgagcagcugaaguccgggacggccagcguggucugccuccugaacaacuucuacccccgggaggccaaggugcaguggaagguggacaacgcgcugcaguccggcaacagccaggagagcgucaccgagcaggacuccaaggacagcaccuacucccucagcuccacccugacgcugagcaaggccgacuacgagaagcacaagguguacgccugcgaggugacccaccagggccucuccagccccgucaccaaguccuucaaccgcggggagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61587 - protein, 447 aa, Artificial Sequence
  Protein (HC) w/o signal peptide encoded by mRNA R3118, R3729, R4120, R5045
QVQLQESGGGLVKPGGSLKLSCAASGFTFSDYYMYWVRQTPEKRLEWVATISDGGSYTYYPDSVKGRFTISRDNAKNNLYLQMSSLKSEDTAMYYCSRYRYDDAMDYWGQGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61588 - protein, 218 aa, Artificial Sequence
  Protein (LC) w/o signal peptide encoded by mRNA R3118, R3729, R4122, R5046
DIELTQSPASLAVSLGQRATISCRASESVDSYGHSFMQWYQQKPGQPPKLLIYRASNLEPGIPARFSGSGSGTDFTLTINPVEADDVATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61589 - RNA, 1341 nt, Artificial Sequence
  CDS (HC) w/o signal peptide encoded by mRNA R3118, R3729, R4120, R5045
caggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaag

SEQ ID NO: 61590 - RNA, 654 nt, Artificial Sequence
  CDS (LC) w/o signal peptide encoded by mRNA R3118, R3729, R4122, R5046
gacaucgagcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugc

SEQ ID NO: 61591 - RNA, 1341 nt, Artificial Sequence
  derived and/or modified sequence opt2 from CDS (HC) w/o signal peptide encoded by mRNA R3118, R3729, R4120, R5045
cagguccagcuccaggaguccggcggcggccucgucaagcccggcggcucccucaagcucuccugcgccgccuccggcuucaccuucuccgacuacuacauguacuggguccgccagacccccgagaagcgccucgagugggucgccaccaucuccgacggcggcuccuacaccuacuaccccgacuccgucaagggccgcuucaccaucucccgcgacaacgccaagaacaaccucuaccuccagauguccucccucaaguccgaggacaccgccauguacuacugcucccgcuaccgcuacgacgacgccauggacuacuggggccagggcaccaccgucaccgucuccuccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61592 - RNA, 654 nt, Artificial Sequence
  derived and/or modified sequence opt2 from CDS (LC) w/o signal peptide encoded by mRNA R3118, R3729, R4122, R5046
gacaucgagcucacccagucccccgccucccucgccgucucccucggccagcgcgccaccaucuccugccgcgccuccgaguccgucgacuccuacggccacuccuucaugcagugguaccagcagaagcccggccagccccccaagcuccucaucuaccgcgccuccaaccucgagcccggcauccccgcccgcuucuccggcuccggcuccggcaccgacuucacccucaccaucaaccccgucgaggccgacgacgucgccaccuacuacugccagcaguccaacgaggaccccuucaccuucggcuccggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61593 - RNA, 1341 nt, Artificial Sequence
  derived and/or modified sequence opt3 from CDS (HC) w/o signal peptide encoded by mRNA R3118, R3729, R4120, R5045
caggugcaacugcaggagagcggcgggggacucgucaagcccgguggcucccuuaaacugucuugcgccgcuucaggguucaccuuuagugacuacuauauguacuggguuagacagacaccugaaaagagguuggaguggguggcaacuaucagcgauggaggcuccuauacguacuauccagacucuguaaaaggucgguucaccauuucgcgcgauaacgccaagaauaacuuauaccugcagaugucaagccuaaaaagugaagacacagcgauguauuacuguucccgauaccguuaugaugacgcuauggauuacugggggcaaggaacuaccgugacagucucuagcuccaccaagggcccgucaguguuuccccucgccccuaguagcaagucuacuuccggcgggacagcagcccugggaugccuuguuaaagacuauuucccagagcccgugaccgucucauggaauagcggugcucugacgaguggcgugcacacuuuuccugcaguauugcagucuuccgggcucuacagccugucgucuguugugaccgucccauccucaagucugggaacacagacuuauauauguaacgugaaucauaagcccagcaacaccaaaguggauaagaaagucgaaccuaaguccugcgacaagacacacaccuguccaccgugccccgccccugagcucuuaggcgguccaucuguuuuccuguuucccccuaaaccaaaggauacgcuuaugaucagcagaacucccgaggugacauguguaguggucgacgugucacaugaagauccggagguuaaauucaauugguacguggacggggucgaagugcacaacgcuaagaccaaaccuagggaggagcaguauaauaguacuuaccggguaguuuccguguugacaguccugcaucaagacuggcuaaacggaaaggaauacaaaugcaaggugagcaauaaggcccuccccgcgccaauugagaaaaccaucucuaaggcaaaaggccagccucgcgaaccccaggucuauacgcugccacccucaagagaugagcuuaccaagaaccaggugagucugacauguuugguuaaaggcuuuuacccuagcgacauugccguggaaugggaguccaaugggcaaccagagaacaauuauaagacuaccccgcccguacucgauucugacggaucguucuuucuguacagcaaguuaacagucgauaaauccagguggcagcaggguaacguguucucaugcaguguuaugcacgaagcucugcacaaccauuauacucaaaagucucucagccuuuccccuggcaaa

SEQ ID NO: 61594 - RNA, 654 nt, Artificial Sequence
  derived and/or modified sequence opt3 from CDS (LC) w/o signal peptide encoded by mRNA R3118, R3729, R4122, R5046
gacaucgagcugacccagagccccgccucccucgcugugucucuuggccaaagagcaacaauuucaugcagggccagugaaagcgucgauuccuacgggcacucuuucaugcagugguaucagcagaagccuggacaaccaccgaaacuguugauauaccgggcgucgaacuuagagcccgguaucccugcucgcuuuucaggcagcgggaguggaacugacuucacgcugaccauuaauccaguugaagccgaugacguggcaacauauuacugucagcaguccaacgaggaucccuuuacuuucggcucugguaccaagcuagaaaucaaacgaacaguagccgcuccuagcguguuuauuuucccacccuccgacgagcagcucaagucagggaccgcaagugucgugugccugcuuaauaacuuuuauccucgugaggccaaaguucaauggaagguggauaaugcucugcagagcggaaacucucaggaauccgucacugagcaggacucaaaggauagcacauacaguuugucuuccacccucacgcugagcaaagccgacuaugaaaagcauaaaguguacgcgugugagguaacucaccaaggccugucgucuccaguuaccaaguccuucaauagaggcgagugc

SEQ ID NO: 61595 - RNA, 1341 nt, Artificial Sequence
  derived and/or modified sequence opt4 from CDS (HC) w/o signal peptide encoded by mRNA R3118, R3729, R4120, R5045
caggugcagcugcaggagagcggcggcggccuggugaagcccggcggcagccugaagcugagcugcgccgccagcggcuucaccuucagcgacuacuacauguacugggugagacagacccccgagaagagacuggaguggguggccaccaucagcgacggcggcagcuacaccuacuaccccgacagcgugaagggcagauucaccaucagcagagacaacgccaagaacaaccuguaccugcagaugagcagccugaagagcgaggacaccgccauguacuacugcagcagauacagauacgacgacgccauggacuacuggggccagggcaccaccgugaccgugagcagcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61596 - RNA, 654 nt, Artificial Sequence
  derived and/or modified sequence opt4 from CDS (LC) w/o signal peptide encoded by mRNA R3118, R3729, R4122, R5046
gacaucgagcugacccagagccccgccagccuggccgugagccugggccagagagccaccaucagcugcagagccagcgagagcguggacagcuacggccacagcuucaugcagugguaccagcagaagcccggccagccccccaagcugcugaucuacagagccagcaaccuggagcccggcauccccgccagauucagcggcagcggcagcggcaccgacuucacccugaccaucaaccccguggaggccgacgacguggccaccuacuacugccagcagagcaacgaggaccccuucaccuucggcagcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61597 - RNA, 1341 nt, Artificial Sequence
  derived and/or modified sequence opt5 from CDS (HC) w/o signal peptide encoded by mRNA R3118, R3729, R4120, R5045
caggugcaacugcaggagagcggcgggggacucgucaagcccggcgggucccugaaacuuucuugcgccgcuagcggauucaccuuuuccgacuacuauauguacuggguuagacagacaccugaaaagcggcuggaguggguggccacgaucucugauggcgggagcuauaccuacuauccggacuccgugaaaggacgcuucacaauuucuagagauaacgcgaagaauaaccucuaccugcagaugagcucccuuaaaagcgaagacaccgcuauguauuacuguucucgguaccgcuaugaugacgccauggauuacuggggccaaggcacaaccgucacaguguccagcucuaccaaggggcccuccguuuuuccucuggcccccagcucuaaguccacgagcggaggcaccgcugcccucgggugccuggugaaagacuauuucccugagcccgucacaguguccuggaacucuggagcucugaccagcggcguucacacauuuccugccgugcuccaguccagcgggcuguacucucuuuccagcgucgugaccgugccgucuagcucccugggaacgcagacauauaucuguaaugucaaucauaagcccucuaacaccaaaguugauaagaaaguggaaccuaagagcugcgacaagacacacaccugucccccuugccccgcgccggagcuccugggcggcccuuccguguuccuuuuucccccuaaacccaaggauacccugaugauuagcagaacacccgaggucacgugugugguuguggacgucucucaugaagauccugaggugaaauucaauugguacguugacgggguggaaguccacaacgccaagaccaaaccgcgggaggagcaguauaauuccacauaccgcguggucagcgugcucaccguucugcaucaagacuggcugaacggaaaggaauacaaaugcaaggugucuaauaaggcucuccccgccccuaucgagaaaacaauuuccaaggcuaaaggccagcccagagaaccucaggucuauacccugcccccgagccgggaugagcuuacgaagaaccaggugucccugacaugucucguuaaaggguuuuacccuucugacaucgccguggaaugggagagcaauggacaacccgagaacaauuauaagaccaccccucccguccuggauuccgacggcucuuucuuucuuuacagcaagcugacaguggauaaaucccgcuggcagcaggggaacguguucagcugcucuguuaugcacgaagcgcuccacaaccauuauacccaaaagucccugagccugucuccuggaaaa

SEQ ID NO: 61598 - RNA, 654 nt, Artificial Sequence
  derived and/or modified sequence opt5 from CDS (LC) w/o signal peptide encoded by mRNA R3118, R3729, R4122, R5046
gacaucgagcugacccagagccccgccucccucgcugugucucugggccaaagagccacaauuagcugccgggcguccgaaucugucgauagcuacgggcacuccuucaugcagugguaucagcagaagccuggacaaccgcccaaacuucugaucuaccgcgcuucuaaccucgagccuggcauucccgccagauuuagcggguccggaagcggcacggacuucacccugacaaucaauccuguugaagccgaugacguggcuaccuauuacugucagcagucuaacgaggaucccuuuacauucggguccggaaccaaacuugaaauuaagcggacaguggccgcuccuagcgucuuuaucuucccgcccucugacgagcagcugaaguccggcaccgccagcgugguuugccuccugaauaacuuuuauccucgcgaggcgaaagugcaauggaaggucgauaaugcccugcagucuggcaacucccaggaaagcgugacggagcaggacuccaaggauucuaccuacagccucuccagcacacugacccuuucuaaagcugacuaugaaaagcauaaaguuuacgccugugaggugacacaccaagggcuguccagccccgucaccaagucuuucaauagaggagagugc

SEQ ID NO: 61599 - RNA, 1341 nt, Artificial Sequence
  derived and/or modified sequence opt6 from CDS (HC) w/o signal peptide encoded by mRNA R3118, R3729, R4120, R5045
caaguacaacuacaagaaucaggagguggacuuguaaaaccaggagguagccuaaaauuaaguugcgcagcuuccggcuucacauucucagacuacuacauguacuggguaagacagacacccgaaaaaagacuagaaugggucgcaacaauaucagauggaggaucuuacacauacuacccagauucuguaaaaggccgauucacaauauccagagauaacgcuaaaaacaacuuauaccuccaaaugucaagccucaaaagugaagacacagcaauguacuauuguucaagauaccgauacgacgacgcaauggacuacuggggacaaggaacaacaguaaccgucucuucaucaacaaaaggaccaucaguauucccacuagccccaucaaguaaaucaacaucaggaggaacagcagcccuuggcuguuuaguaaaagacuacuucccagaaccaguaacaguaucauggaauucaggagcacuaacaucaggaguacacacauuccccgcaguauuacaaucaucaggcuuauauucacuaucaaguguuguaaccguaccaucaucaagcuuaggaacccaaacauacauauguaauguuaaccauaaaccaagcaauacuaaaguagacaaaaaaguugaaccaaaaucuugugacaaaacucauacuugccccccauguccagcaccagaacuauuaggaggaccaucaguuuuccuauucccacccaaaccaaaagacacacuaaugaucucaagaacaccagaagucacaugcguagucguagauguaucacaugaagacccagaaguuaaauucaacugguacguagacggaguagaaguacauaaugcaaaaacaaaaccaagagaagaacaauauaacucaacauacagaguaguuucaguucuaacaguacuucaccaagacugguuaaacgguaaggaauauaaauguaaaguaucaaacaaagcacuaccugccccaauagaaaaaacaauaucaaaagcuaaaggacaacccagagaaccccaaguauauacacuaccaccgucacgagacgaacuaacaaaaaaccaagucucacuaacaugccuaguaaaaggauucuauccuucugacauagccguagaaugggaaucaaacggacaaccagaaaacaacuacaaaacaacaccaccaguccuagauucagauggaucauucuucuuauacucaaaauuaacaguggauaaaucaagauggcaacaagguaacguauucucuuguaguguuaugcaugaagcacuacauaaccauuacacucaaaaaucacuuucacuaaguccaggaaaa

SEQ ID NO: 61600 - RNA, 654 nt, Artificial Sequence
  derived and/or modified sequence opt6 from CDS (LC) w/o signal peptide encoded by mRNA R3118, R3729, R4122, R5046
gacauagaacuaacacaaucacccgcaucacuagcaguaucauuaggacaaagagcaacaaucucaugcagagcaucagaaucaguagacucauacggacacucauucaugcaaugguaccaacaaaaaccaggccaaccaccaaaacuacuaauauacagagcaucaaaccuugaaccaggaaucccagcaagauucucaggaucaggaucaggaacagacuucaccuuaacaauaaacccaguagaagcagacgacguagcaaccuauuauugccaacaaucaaacgaagacccauucacauucggaucaggaacaaaacuugaaauaaaaagaaccguagcagcaccaucaguauucauauucccaccaucagacgaacaacuaaaaucaggaacagcaucaguaguaugcuuacucaacaacuucuaccccagagaagcaaaaguacaauggaaaguagauaacgcacuccaaucaggaaacucacaagaaucaguaacagaacaagauucaaaagacucaaccuacagcuuaucaucaacacuaacacuaucaaaagcagacuacgaaaaacacaaaguauacgcaugcgaagucacacaccaaggacuaucaucaccaguaacaaaaucauucaacagaggagaaugc

SEQ ID NO: 61601 - RNA, 1341 nt, Artificial Sequence
  derived and/or modified sequence opt11 from CDS (HC) w/o signal peptide encoded by mRNA R3118, R3729, R4120, R5045
cagguccaacuacaagaaucaggaggcggacucgucaaacccggcggcucccuuaaacucuccugcgccgccuccggcuuuaccuucagcgacuacuacauguacugggucagacaaacccccgaaaaacgccucgaaugggucgcaaccauauccgacggcggcucauacaccuacuaccccgacuccguaaaaggcagauucaccaucucccgcgacaacgccaaaaacaaccuuuaccuccaaauguccucccuaaaaucagaagacacagcaauguacuacugcucccgauaccgauacgacgacgccauggacuacuggggccaaggcacaaccgucaccguaagcuccuccaccaaaggccccuccgucuucccccuagcccccuccuccaaauccaccuccggcggcaccgccgcucuuggcugccucguuaaagacuacuuucccgaacccgucaccguauccuggaacuccggcgcacuaaccuccggcguccacacauuccccgccguccuccaaucauccggccucuauucacucuccagcgucguaacaguccccuccucuucccuaggaacccaaaccuauaucugcaaugucaaccacaaacccuccaacacgaaaguagacaagaaagucgaacccaaauccugcgacaaaacgcacacaugcccacccugccccgcaccagaacuccucggcggcccauccgucuuccuauucccaccaaaaccaaaagacacucuaaugauaucccgcacccccgaaguaacaugcgucgucgucgacgucagccacgaagacccugaagugaaauucaacugguacguagacggcguagaaguccacaacgccaaaacaaaaccccgagaagaacaauacaacuccacauaucgcgucguaucaguucucaccguccuucaccaagacuggcugaacggcaaagaauacaaaugcaaagucagcaacaaagcacuccccgcccccauagaaaagaccauaucuaaagccaaaggacaaccccgcgaaccccaggucuacacacucccacccuccagagaugaacuaaccaaaaaucaggucucacuuaccugccucguaaaagguuucuaccccucagacaucgccgucgaaugggaauccaacggccaacccgaaaacaacuacaaaaccaccccacccguucucgacuccgacggcuccuucuuccucuacucaaaacucaccguagacaaaucacgauggcagcaaggcaacgucuuuucaugcucagucaugcacgaagcccuacacaaccacuacacccaaaaaucccuaucacucucccccggcaaa

SEQ ID NO: 61602 - RNA, 654 nt, Artificial Sequence
  derived and/or modified sequence opt11 from CDS (LC) w/o signal peptide encoded by mRNA R3118, R3729, R4122, R5046
gacaucgaacuaacccaaagccccgccucccucgccgucucccucggccaacgcgccaccaucuccugccgcgccuccgaauccgucgacuccuacggccacuccuucaugcaaugguaccaacaaaaacccggccaaccacccaaacuccuaaucuaccgcgccuccaaccucgaacccggaauccccgcccgcuucuccggcuccggcuccggcaccgacuucacccuaaccaucaaccccguagaagcagacgacgucgccaccuacuacugccaacaauccaacgaagaccccuucacauucggauccggcaccaaacucgaaaucaaacgcaccgucgcagcccccuccgucuucaucuuucccccauccgacgaacaacucaaaucaggcacagccuccgucguaugccuccucaacaacuucuacccccgagaagccaaaguccaauggaaagucgacaacgcccuccaauccggcaacucccaagaauccgucaccgaacaagacuccaaagacuccaccuacucacuauccuccacccucacacuuuccaaagccgacuacgaaaaacauaaagucuacgccugcgaagucacccaccaaggccucuccucccccgucaccaaauccuucaaccgaggcgaaugc

SEQ ID NO: 61603 - protein, 466 aa, Artificial Sequence
  Protein (HC) encoded by mRNA R4120
MKCSWVIFFLMAVVTGVNSQVQLQESGGGLVKPGGSLKLSCAASGFTFSDYYMYWVRQTPEKRLEWVATISDGGSYTYYPDSVKGRFTISRDNAKNNLYLQMSSLKSEDTAMYYCSRYRYDDAMDYWGQGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61604 - RNA, 1401 nt, Artificial Sequence
  CDS (HC) as RNA from mRNA R4120
augaagugcagcugggugaucuucuuccugauggccgucgugaccggcgugaacucccaggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaaguga

SEQ ID NO: 61605 - RNA, 1605 nt, Artificial Sequence
  R4120
gggagaaagcuuaccaugaagugcagcugggugaucuucuuccugauggccgucgugaccggcgugaacucccaggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61606 - protein, 237 aa, Artificial Sequence
  Protein (LC) encoded by mRNA R4122
MKLPVRLLVLMFWIPASSSDIVLTQSPASLAVSLGQRATISCRASESVDSYGHSFMQWYQQKPGQPPKLLIYRASNLEPGIPARFSGSGSGTDFTLTINPVEADDVATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61607 - RNA, 714 nt, Artificial Sequence
  CDS (LC) as RNA from mRNA R4122
augaagcugcccgugcgccuccugguccugauguucuggaucccggccagcuccagcgacaucgugcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61608 - RNA, 918 nt, Artificial Sequence
  R4122
gggagaaagcuuaccaugaagcugcccgugcgccuccugguccugauguucuggaucccggccagcuccagcgacaucgugcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61609 - protein, 472 aa, Artificial Sequence
  Protein (HC) encoded by mRNA R5045, R3118, R3729
MAVMAPRTLVLLLSGALALTQTWAGQVQLQESGGGLVKPGGSLKLSCAASGFTFSDYYMYWVRQTPEKRLEWVATISDGGSYTYYPDSVKGRFTISRDNAKNNLYLQMSSLKSEDTAMYYCSRYRYDDAMDYWGQGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61610 - RNA, 1419 nt, Artificial Sequence
  CDS (HC) as RNA from mRNA R5045, R3118, R3729
auggccgugauggcgccgcggacccugguccuccugcugagcggcgcccucgcccugacgcagaccugggccgggcaggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaaguga

SEQ ID NO: 61611 - RNA, 1623 nt, Artificial Sequence
  R5045
gggagaaagcuuaccauggccgugauggcgccgcggacccugguccuccugcugagcggcgcccucgcccugacgcagaccugggccgggcaggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61612 - protein, 243 aa, Artificial Sequence
  Protein (LC) encoded by mRNA R5046, R3118, R3729
MAVMAPRTLVLLLSGALALTQTWAGDIELTQSPASLAVSLGQRATISCRASESVDSYGHSFMQWYQQKPGQPPKLLIYRASNLEPGIPARFSGSGSGTDFTLTINPVEADDVATYYCQQSNEDPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61613 - RNA, 732 nt, Artificial Sequence
  CDS (LC) as RNA from mRNA R5046, R3118, R3729
auggccgugauggcgccgcggacccugguccuccugcugagcggcgcccucgcccugacgcagaccugggccggggacaucgagcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61614 - RNA, 936 nt, Artificial Sequence
  R5046
gggagaaagcuuaccauggccgugauggcgccgcggacccugguccuccugcugagcggcgcccucgcccugacgcagaccugggccggggacaucgagcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61615 - RNA, 2830 nt, Artificial Sequence
  CDS 1-IRES-CDS 2 as RNA from mRNA R3118, R3729
auggccgugauggcgccgcggacccugguccuccugcugagcggcgcccucgcccugacgcagaccugggccgggcaggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacaucgagcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61616 - RNA, 3212 nt, Artificial Sequence
  R3118
ggggcgcugccuacggagguggcagccaucuccuucucggcaucaagcuuaccauggccgugauggcgccgcggacccugguccuccugcugagcggcgcccucgcccugacgcagaccugggccgggcaggugcagcugcaggagagcggcgggggccucgucaagcccgggggcucccugaagcugagcugcgccgccuccggguucaccuucagcgacuacuacauguacugggugcgccagaccccggagaagcggcucgaguggguggcgacgaucuccgacggcggcagcuacaccuacuaccccgacuccgucaaggggcgcuucaccaucagccgggacaacgccaagaacaaccuguaccugcagauguccagccucaaguccgaggacaccgccauguacuacugcagccgcuaccgguacgacgacgccauggacuacuggggccaggggacgaccgugaccguguccagcagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacaucgagcugacccagagccccgccucccucgccgugagccugggccagcgcgcgaccaucuccugccgggccagcgaguccgucgacagcuacgggcacuccuucaugcagugguaccagcagaagccgggccagccucccaagcugcucaucuaccgcgccagcaaccuggagcccgggaucccggcccgguucuccggcagcggguccggcacggacuucacccugaccaucaaccccguggaggccgacgacguggcgaccuacuacugccagcagagcaacgaggaccccuucacguucggcuccgggaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61617 - RNA, 3002 nt, Artificial Sequence; identical to SEQ ID NO: 61465
  R3729

SEQ ID NO: 61618 - protein, 504 aa, Artificial Sequence; identical to SEQ ID NO: 107
  Protein w/o signal peptide encoded by mRNA R3979, R3981

SEQ ID NO: 61619 - protein, 498 aa, Artificial Sequence; identical to SEQ ID NO: 964
  Protein w/o signal peptide & his-tag encoded by mRNA R3979, R3981

SEQ ID NO: 61620 - RNA, 1512 nt, Artificial Sequence
  CDS w/o signal peptide encoded by mRNA R3979, R3981
gacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaagcaccaccaccaccaccac

SEQ ID NO: 61621 - RNA, 1494 nt, Artificial Sequence
  CDS w/o signal peptide & his-tag encoded by mRNA R3979, R3981
gacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaag

SEQ ID NO: 61622 - RNA, 1512 nt, Artificial Sequence; identical to SEQ ID NO: 15391
  derived and/or modified sequence opt2 from CDS w/o signal peptide encoded by mRNA R3979, R3981

SEQ ID NO: 61623 - RNA, 1494 nt, Artificial Sequence; identical to SEQ ID NO: 16248
  derived and/or modified sequence opt2 from CDS w/o signal peptide & his-tag encoded by mRNA R3979, R3981

SEQ ID NO: 61624 - RNA, 1512 nt, Artificial Sequence; identical to SEQ ID NO: 23033
  derived and/or modified sequence opt3 from CDS w/o signal peptide encoded by mRNA R3979, R3981

SEQ ID NO: 61625 - RNA, 1494 nt, Artificial Sequence; identical to SEQ ID NO: 23890
  derived and/or modified sequence opt3 from CDS w/o signal peptide & his-tag encoded by mRNA R3979, R3981

SEQ ID NO: 61626 - RNA, 1512 nt, Artificial Sequence; identical to SEQ ID NO: 30675
  derived and/or modified sequence opt4 from CDS w/o signal peptide encoded by mRNA R3979, R3981

SEQ ID NO: 61627 - RNA, 1494 nt, Artificial Sequence; identical to SEQ ID NO: 31532
  derived and/or modified sequence opt4 from CDS w/o signal peptide & his-tag encoded by mRNA R3979, R3981

SEQ ID NO: 61628 - RNA, 1512 nt, Artificial Sequence; identical to SEQ ID NO: 38317
  derived and/or modified sequence opt5 from CDS w/o signal peptide encoded by mRNA R3979, R3981

SEQ ID NO: 61629 - RNA, 1494 nt, Artificial Sequence; identical to SEQ ID NO: 39174
  derived and/or modified sequence opt5 from CDS w/o signal peptide & his-tag encoded by mRNA R3979, R3981

SEQ ID NO: 61630 - RNA, 1512 nt, Artificial Sequence
  derived and/or modified sequence opt6 from CDS w/o signal peptide encoded by mRNA R3979, R3981
gauauacaauuaacccaaucgccagcaagccuugcaguauccuuaggacaaagagcaacgauaaguugcaaagcaagucaaucaguagacuaugacggugauaguuauuuaaacugguaucaacaaauaccaggacaaccaccaaaauuauuaauauaugacgcaucuaaccuaguaagugguauacccccaagauucucaggaucagguucaggaacagauuucaccuuaaauauacaucccguagaaaaaguugaugccgcaacauaucauugucaacaaucaacagaagauccguggacuuucgguggaggaacaaaauuagaaauuaaaggaggaggagguucaggagguggaggaucaggaggagguggaucacaaguucaacuacaacaauccggagcagagcuaguaagaccaggaagcucagucaaaauaagcuguaaagcaucagguuaugcauuuaguucauauuggaugaauuggguaaaacaacguccuggacaaggcuuagaauggauaggacaaauauggccaggagauggugauacaaauuauaauggaaaauuuaaaggcaaagcaacacuaacagcagaugaaaguucaucaacugcuuacaugcaacuaucaagccuagcuagugaagauagcgccguauacuuuugugcaagaagggaaacuacaacaguuggucgauauuacuaugcaauggauuauuggggacagggaacuacaguaacaguuucaucaggaggaggaggaagcgauaucaaauuacaacaaagcggagcagaacuagcacgaccuggcgcaucaguaaaaaugucuugcaaaacgaguggauauacauuuacaagauauacaaugcacuggguaaaacaaagaccaggacaaggauuagaauggauuggguacauuaaucccucaagagguuauacaaauuauaaucaaaaauuuaaagauaaagcuacacuaacaacagacaaaucaucaaguaccgcauacaugcaacuaucaagucucacaucagaagacagcgccgucuacuauugugcuagauacuacgacgaucauuauugucuagauuauuggggacaaggaacaaccuuaacuguaagcucaguagaaggaggaagcggaggaucaggaggaaguggaggaucuggaggaguugaugauauacaacuaacacaaucaccagcaaucaugagugcaucuccaggagaaaaaguuacgaugacuugcagagcuucaucaucaguaucauauaugaauugguaucagcaaaaaucaggcacaaguccaaaaagauggaucuacgacacaucaaaaguugcuucaggaguacccuauagauuuaguggaucaggaucgggaacaucauauucauuaacaauaucaucaauggaagcugaagaugcagcaacauacuauugccaacaauggaguucaaaccccuuaacauuuggagcagguacaaaacuagaacuaaaacaucaucaucaucaucau

SEQ ID NO: 61631 - RNA, 1494 nt, Artificial Sequence
  derived and/or modified sequence opt6 from CDS w/o signal peptide & his-tag encoded by mRNA R3979, R3981
gauauacaauuaacacaaucaccagcaucucuagcaguuagcuugggacaaagagcuacaauaagcuguaaagcaagucaaucagucgauuacgauggugauaguuacuuaaacugguaucaacaaauaccaggacaaccaccuaaauuacuaauauaugacgcaucaaauuuaguaagcggaaucccuccaagauuuucaggaucaggaucaggaacagacuuuacauuaaacauccauccaguagaaaaaguagaugcugcaacauaucacugucaacaaagcaccgaagauccauggaccuuuggaggcggaacuaaguuagagauuaaaggaggaggaggcucagguggagguggaucaggagggggaggaagccaaguacaauuacaacaaucaggagcagaauuaguuagaccaggaucaaguguaaaaauaucauguaaagcaucaggauaugcauuuaguucauacuggaugaauugggugaaacaacgaccaggacaaggcuuagaauggauagggcaaauauggccuggagauggugauacaaauuauaauggaaaauuuaaaggaaaagcuacacucacagcagaugaaagcucaagcacagcauacaugcaacuaucaucuuuagcaagcgaagacucagcaguguacuuuugugcgagaagagaaacuacaacaguaggaagguacuauuaugcaauggauuauuggggacaaggaacaacaguaacaguaucaagcggaggaggaggaucagacauaaaacuacaacaaaguggcgcagaauuagcaagaccaggagcaagcguaaaaaugagcuguaaaacaagcgguuauacuuuuacaagauauacaaugcauuggguuaaacaaagaccaggucaaggauuagaauggauaggauauauaaauccaucaagaggauauacaaacuauaaucaaaaauuuaaagauaaagcaacauuaaccacagauaaaucuucaaguacugcuuauaugcaauuaucaaguuuaacaucagaagauagcgcaguauauuacugugcuagguauuaugaugaccauuauugcuuggacuacuggggacaagguacaacccuaacaguaaguagcguggaaggaggcaguggaggaagcggaggaaguggaggaaguggaggaguagaugauauacaacuaacacaaucaccagcaauaaugagugcaucaccaggagaaaaaguuacaaugacaugcagagcaucaaguaguguaaguuauaugaauugguaucaacaaaaaucaggaacaaguccgaaaagauggauauaugauacuucaaaaguagcaucuggagugccauacagauuuagcggaaguggaagugguacaagcuauucauuaacaauaaguaguauggaagcagaagacgcagcaacuuauuauugccaacaauggaguagcaauccauuaacauuuggagcaggaacaaaauuagaauuaaaa

SEQ ID NO: 61632 - RNA, 1512 nt, Artificial Sequence
  derived and/or modified sequence opt11 from CDS w/o signal peptide encoded by mRNA R3979, R3981
gacauccaacuaacacaaagccccgccucccucgcaguaagucuaggacagcgcgcgacaauuaguugcaaagcaagccaaagcgucgacuacgacggcgacuccuaccuaaacugguaccaacagauccccggccaaccaccaaaacuccuaaucuacgacgcuagcaaccuugucagcggcaucccaccccgcuucuccggcucaggcagcggcacagacuucacucuaaacauacacccagucgaaaaaguagacgcagccacauaucacugccaacaaucaaccgaagacccauggacauucggaggaggaaccaaacucgaaaucaagggcggcggcggaucaggcggcggaggcagcggcggaggaggcagccaaguccaacuccaacaauccggcgcagagcuaguccgaccaggcagcagcgucaaaauaucaugcaaagcaagcggcuacgcauucuccucauacuggaugaacuggguaaaacagagaccaggacagggccucgaauggauaggacaaauauggccaggagacggcgacaccaacuacaacggaaaauucaagggaaaagccacccuaaccgccgacgaaucaagcucaacagccuacaugcaacucagcucacuagcauccgaagacagcgcggucuacuucugcgcgcgccgcgaaacaaccaccgucggacguuacuacuacgccauggacuacuggggccaagggaccacaguaacggucucuuccggcgguggcggcucagacauaaaacugcaacagagcggagcagaacuagcaagacccggcgcaagcguaaaaauguccugcaaaacgagcggguacacauucacacguuacacuaugcacugggucaaacaaagacccggccaaggacuagaauggauaggauacaucaacccauccagaggguacacaaacuacaaccaaaaauucaaggacaaagccacucucacaacggacaaaagcuccagcacagcauacaugcaacuaucauccuuaaccucagaagacuccgcugucuacuacugcgcacgcuacuacgacgaccacuacugccuagacuacuggggccaaggaaccacacuaaccguguccucagucgaaggcggcuccggcggcagcggcggaagcggcggauccggaggagucgacgacauacaacucacccaauccccagcaaucaugucagccucacccggcgaaaaaguaaccaugaccugccgagcaagcuccucaguaagcuacaugaacugguaccaacagaaaagcggcacauccccaaaacgauggaucuacgacacaagcaaaguagccuccggaguaccauaccgcuucagcggaagcggcagcggaacaagcuacucgcucacaaucucaagcauggaagccgaagacgcagccaccuacuacugccaacaaugguccuccaacccacuaaccuucggcgcgggcacaaaacuagaacuaaaacaccaccaccaccaccac

SEQ ID NO: 61633 - RNA, 1494 nt, Artificial Sequence
  derived and/or modified sequence opt11 from CDS w/o signal peptide & his-tag encoded by mRNA R3979, R3981
gacauccaacucacgcaauccccagcaagccuggccgucucacuuggccaaagagcaaccauaagcugcaaagccagccaaagcguagacuacgacggggacucuuaccuuaacugguaccagcaaauacccgggcaaccaccaaagcuacuaaucuacgacgcgagcaaccuagucagcggaaucccacccagguucucgggcucaggaagcggcacugacuucacccuaaacauacacccaguagaaaaaguagacgcagccacauaucacugccagcaaucgacagaagacccauggacguucggaggcgggaccaaacucgaaaucaaaggcggaggaggcuccggaggcggaggcucgggagggggcggaagccaaguccaacuacaacaauccggcgcagagcuaguaagaccgggcagcagcguuaaaaucuccugcaaagccucgggcuacgccuucucaucauacuggaugaacuggguaaaacaaagaccaggacaaggacuagaauggaucgggcaaauauggcccggagacggggacacaaauuacaacggaaaguucaaaggcaaagcaacacucacagcagacgaaucaagcucaaccgcguacaugcaacuaagcucgcuggcguccgaagacucagcaguauacuucugcgcgcgcagagaaaccaccacagucggccgcuacuacuacgcaauggacuacuggggacaaggaaccaccgucacaguaucaagcgggggcgggggauccgacauaaaacuacaacagagcggggccgaacucgcccgacccggagcgagcgugaaaaugagcugcaaaacaagcggguacacguucacccgcuacacuaugcacugggucaagcaacgccccggucaaggacuagaauggaucggauacaucaaccccucccgaggcuacacaaacuacaaccaaaaauucaaagacaaagcaacacuaaccacagacaaaagcucaucaacagccuauaugcaacucucaagccugaccucagaagauagcgcagucuacuacugugcaagauacuacgacgaccacuacugccucgacuacuggggacaagggaccacacuaaccgucucgagcgucgaaggaggcucaggagggagcggcggcuccggcggguccggcggagucgacgacauacagcucacgcaaucaccagcaaucaugagcgcaagccccggcgaaaaagucaccaugacaugccgagcguccuccagcguaagcuacaugaacugguaccaacagaaaucaggaacgagcccgaaaagguggauauacgacacaucgaaaguagccucgggcguacccuaccgcuuuagcggaagcgggagcggaaccucguacucacucacaaucucgagcauggaagcagaagacgccgcgacauacuacugucaacaaugguccuccaacccccuaaccuucggcgcaggaacaaaacuagaacuaaaa

SEQ ID NO: 61634 - protein, 523 aa, Artificial Sequence
  Protein w/o his-tag encoded by mRNA R3979
MAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 61635 - protein, 529 aa, Artificial Sequence
  Protein encoded by mRNA R3979
MAVMAPRTLVLLLSGALALTQTWAGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 61636 - RNA, 1572 nt, Artificial Sequence
  CDS w/o his-tag as RNA from mRNA R3979
auggccgugauggccccgcggacccugguccuccugcugagcggcgcgcucgcccugacccagacgugggccggggacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaaguga

SEQ ID NO: 61637 - RNA, 1590 nt, Artificial Sequence
  CDS as RNA from mRNA R3979
auggccgugauggccccgcggacccugguccuccugcugagcggcgcgcucgcccugacccagacgugggccggggacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaagcaccaccaccaccaccacuga

SEQ ID NO: 61638 - RNA, 1782 nt, Artificial Sequence
  R3979
gggagaaagcuuaccauggccgugauggccccgcggacccugguccuccugcugagcggcgcgcucgcccugacccagacgugggccggggacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaagcaccaccaccaccaccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61639 - protein, 520 aa, Artificial Sequence
  Protein w/o his-tag encoded by mRNA R3981
MDFQVQIFSFLLISASVIISRGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 61640 - protein, 526 aa, Artificial Sequence
  Protein encoded by mRNA R3981
MDFQVQIFSFLLISASVIISRGDIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 61641 - RNA, 1563 nt, Artificial Sequence
  CDS w/o his-tag as RNA from mRNA R3981
auggacuuccaggugcagaucuucagcuuccugcucaucuccgccagcgucaucaucucccgcggcgacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaaguga

SEQ ID NO: 61642 - RNA, 1581 nt, Artificial Sequence
  CDS as RNA from mRNA R3981
auggacuuccaggugcagaucuucagcuuccugcucaucuccgccagcgucaucaucucccgcggcgacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaagcaccaccaccaccaccacuga

SEQ ID NO: 61643 - RNA, 1773 nt, Artificial Sequence
  R3981
gggagaaagcuuaccauggacuuccaggugcagaucuucagcuuccugcucaucuccgccagcgucaucaucucccgcggcgacauccagcugacccagagccccgccucccucgccgugagccugggccagcgcgcgaccaucuccugcaaggccagccaguccgucgacuacgacggggacagcuaccugaacugguaccagcagauccccggccagcccccgaagcuccugaucuacgacgccuccaaccuggugagcgggaucccgccgcgguucuccggcagcggguccggcacggacuucacccucaacauccaccccguggagaaggucgacgccgccaccuaccacugccagcagagcaccgaggaccccuggacguucggcgggggcaccaagcuggagaucaagggcggcgggggguccggcgggggcgggagcggcggcgggggcucccaggugcagcugcagcagagcggggcggagcucgugcgccccggcuccagcgucaagaucuccugcaaggccagcggguacgccuucagcuccuacuggaugaacugggugaagcagcggccgggccagggccuggaguggaucgggcagaucuggcccggcgacggggacaccaacuacaacggcaaguucaaggggaaggccacccugacggcggacgagagcuccagcaccgccuacaugcagcucuccagccuggccuccgaggacagcgccguguacuucugcgcccgccgggagaccaccacggucggccgcuacuacuacgcgauggacuacuggggccaggggaccaccgugaccguguccagcggcgggggcggguccgacaucaagcugcagcagagcggcgccgagcucgcccggcccggcgccuccgucaagaugagcugcaagacguccggguacaccuucacccgcuacaccaugcacugggugaagcagcggcccggccaggggcuggaguggaucggcuacaucaacccgagccgcggcuacacgaacuacaaccagaaguucaaggacaaggccacccugaccaccgacaaguccagcuccacggcguacaugcagcucagcagccugaccuccgaggacagcgccguguacuacugcgcccgguacuacgacgaccacuacugccuggacuacugggggcagggcaccacccucacggucuccagcguggagggcggguccgggggcagcggcggguccggcgggagcggcgggguggacgacauccagcugacccagucccccgccaucaugagcgccucccccggcgagaaggucaccaugaccugccgcgcgagcuccagcguguccuacaugaacugguaccagcagaagagcggcacgucccccaagcgguggaucuacgacaccagcaagguggccagcggggucccguaccgcuucuccggcagcggguccggcaccagcuacucccugaccaucagcuccauggaggccgaggacgccgccacguacuacugccagcaguggagcuccaacccccucaccuucggggcgggcaccaagcuggagcugaagcaccaccaccaccaccacugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61644 - protein, 449 aa, Artificial Sequence
  Protein (HC) w/o signal peptide encoded by mRNA R3058, R3060
QVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61645 - protein, 212 aa, Artificial Sequence
  Protein (LC) w/o signal peptide encoded by mRNA R3058, R3060
DIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61646 - RNA, 1347 nt, Artificial Sequence
  CDS (HC) w/o signal peptide encoded by mRNA R3058, R3060
cagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaag

SEQ ID NO: 61647 - RNA, 636 nt, Artificial Sequence
  CDS (LC) w/o signal peptide encoded by mRNA R3058, R3060
gacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugc

SEQ ID NO: 61648 - RNA, 1347 nt, Artificial Sequence
  derived and/or modified sequence opt2 from CDS (HC) w/o signal peptide encoded by mRNA R3058, R3060
caggucgagcuccaggaguccggccccggcauccuccagcccucccagacccucucccucaccugcuccuucuccggcuucucccucuccaccuccggcauguccgucggcuggauccgccagcccuccggcgagggccucgaguggcucgccgacaucuggugggacgacaagaaggacuacaaccccucccucaagucccgccucaccaucuccaaggacaccuccuccaaccaggucuuccucaagaucaccggcgucgacaccgccgacaccgccaccuacuacugcgcccgcuccaugaucaccaacugguacuucgacgucuggggcgccggcaccaccgucaccgucuccuccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61649 - RNA, 636 nt, Artificial Sequence
  derived and/or modified sequence opt2 from CDS (LC) w/o signal peptide encoded by mRNA R3058, R3060
gacauccagcucacccagucccccgccaucauguccgccucccccggcgagaaggucaccaugaccugcuccgccuccuccuccgucggcuacaugcacugguaccagcagaaguccuccaccucccccaagcucuggaucuacgacaccuccaagcucgccuccggcguccccggccgcuucuccggcuccggcuccggcaacuccuacucccucaccaucuccuccauccaggccgaggacgucgccaccuacuacugcuuccagggcuccggcuaccccuucaccuucggcggcggcaccaagcucgagaucaagaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61650 - RNA, 1347 nt, Artificial Sequence
  derived and/or modified sequence opt3 from CDS (HC) w/o signal peptide encoded by mRNA R3058, R3060
cagguggagcugcaagaaagcggccccgggauccuccagccuucccagacccuuucucugacaugcucauucaguggauuuagcuuguccacuucugguaugucggucggcuggauuagacagccaucaggggagggauuagaauggcuggccgacauauggugggaugacaagaaagauuacaacccgagccuaaagaguaggcucacgaucuccaaagacaccucuagcaaucaaguuuuccugaagauuacaggcguggauacugcugacaccgcaacauauuacugugcccgguccaugaucaccaacugguauuuugauguauggggugcggggacuacagugaccgucucaaguagcacgaaaggacccucuguguucccucuugcuccauccucaaagagcacaaguggcggcaccgccgcacuggggugcuugguuaaggacuacuuucccgagccugugacagucucuuggaacuccggagcccucacuagcggugugcacaccuucccagcuguacugcagucgucuggccuguauucccucucaaguguugugacaguccccagcuccucuuuagggacccagacguacauuuguaaugugaaucauaaaccuagcaacacuaagguggauaaaaaggucgaaccaaaaucaugcgacaagacacacaccuguccgcccugcccugcaccagagcugcuuggaggccccaguguuuuucuuuucccuccaaagcccaaagauacucugaugaucucccgcacaccggaggugaccuguguaguggucgacgugagccaugaagauccugagguuaaguuuaauugguauguggacggugucgaagugcacaacgccaaaacgaagccccgagaggagcaguacaauucuaccuaccguguaguuucagugcuaacaguccuccaucaagacuggcugaacgggaaagaauauaagugcaaagugaguaauaaggcuuugccagccccuauagagaagacuaucagcaaagcgaagggacagcccagagaaccacaggucuacacccugcccccuuccagggaugaguugacuaaaaaccaggugucucucacuugucugguuaagggcuucuauccaucggacauugcaguggaaugggagagcaauggccaaccggagaacaauuacaaaaccacacccccuguauuagauuccgacgggucauuuuuccuguauaguaagcucaccgucgauaagucucgguggcagcagggaaacguguuuagcugcuccguuaugcacgaagcccuucacaaccauuacacucaaaaaucacugagcuugucuccagguaag

SEQ ID NO: 61651 - RNA, 636 nt, Artificial Sequence
  derived and/or modified sequence opt3 from CDS (LC) w/o signal peptide encoded by mRNA R3058, R3060
gacauccagcugacccaaagccccgccauuauguccgcuucuccuggcgagaaggugacaaugacuugcucagcaaguagcuccgucggguacaugcacugguaucagcagaaaucuucgacgucaccaaagcucuggauauacgauaccagcaaacuugccaguggaguuccggguagauucuccggcucugggagcggaaacuccuauucacugacaaucaguagcauucaggcggaagacguggcuacuuacuauuguuuucaaggcucugguuaccccuucaccuuugggggaggcacaaaguuggagaucaaaaccguagccgcaccuuccguguucauuuuuccacccucagaugaacaguuaaagagcggcacugccagugucgugugccugcuaaauaacuucuauccuagggaggcuaagguucaguggaaaguggacaaugcacuccagucugggaacucccaagaaagcgucacagagcaggauucgaaggacucuaccuacucccugucaaguacgcuuacucugagcaaagccgauuacgagaagcauaaaguguaugcuugugaaguaacccaccagggauuguccucuccaguuacaaagagcuuuaaucggggugagugc

SEQ ID NO: 61652 - RNA, 1347 nt, Artificial Sequence
  derived and/or modified sequence opt4 from CDS (HC) w/o signal peptide encoded by mRNA R3058, R3060
cagguggagcugcaggagagcggccccggcauccugcagcccagccagacccugagccugaccugcagcuucagcggcuucagccugagcaccagcggcaugagcgugggcuggaucagacagcccagcggcgagggccuggaguggcuggccgacaucuggugggacgacaagaaggacuacaaccccagccugaagagcagacugaccaucagcaaggacaccagcagcaaccagguguuccugaagaucaccggcguggacaccgccgacaccgccaccuacuacugcgccagaagcaugaucaccaacugguacuucgacguguggggcgccggcaccaccgugaccgugagcagcagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61653 - RNA, 636 nt, Artificial Sequence
  derived and/or modified sequence opt4 from CDS (LC) w/o signal peptide encoded by mRNA R3058, R3060
gacauccagcugacccagagccccgccaucaugagcgccagccccggcgagaaggugaccaugaccugcagcgccagcagcagcgugggcuacaugcacugguaccagcagaagagcagcaccagccccaagcuguggaucuacgacaccagcaagcuggccagcggcgugcccggcagauucagcggcagcggcagcggcaacagcuacagccugaccaucagcagcauccaggccgaggacguggccaccuacuacugcuuccagggcagcggcuaccccuucaccuucggcggcggcaccaagcuggagaucaagaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61654 - RNA, 1347 nt, Artificial Sequence
  derived and/or modified sequence opt5 from CDS (HC) w/o signal peptide encoded by mRNA R3058, R3060
cagguggagcugcaagaaagcggccccgggauccuccagccuucccagacccugucucuuacaugcagcuucuccggauuuucucugagcacguccggcaugucugucggguggauuagacagccgagcggagagggccucgaauggcuggccgacaucuggugggaugacaagaaagauuacaaccccucccuuaagagccggcugaccauuucuaaagacacauccagcaaucaaguuuuccucaagaucaccgggguggauacagcugacaccgccacauauuacugugcgcgcucuaugauuaccaacugguauuuugauguguggggagcuggcacgaccgucacaguguccagcucuaccaaaggcccuuccguuuucccccuggccccuagcuccaagucuacaagcgggggaaccgccgcucugggcugccucgugaaggacuacuuucccgagccugucacgguguccuggaauagcggggcccugacaucuggaguucacaccuucccggcugugcuucaguccagcggccuguauucucucagcuccgucgugacagugcccucuagcucccuggggacccagaccuacaucuguaacgucaaucauaaaccuagcaacacaaagguugauaaaaagguggaacccaaaucuugcgacaagacgcacaccuguccucccugcccggccccugagcuucugggaggccccuccguguuucucuucccucccaagcccaaagauacacugaugaucagcagaaccccugaggucacaugugugguuguggacgucucucaugaagauccggaggugaaguuuaauugguauguugacggcguggaaguccacaacgcgaaaaccaagccccgggaggagcaguacaauuccacguaccgcguggucagcgugcugacaguucuccaucaagacuggcugaacgggaaagaauauaagugcaaaguguccaauaaggcccuuccugcucccauugagaagaccaucucuaaagccaagggacagccuagagaaccccaggucuacacccugccgccuagccgggaugagcucaccaaaaaccaggugucccugacaugucuuguuaagggcuucuaucccucugacauugcuguggaaugggagagcaaugggcaaccugagaacaauuacaaaacaacgcccccuguccuggauuccgacggcagcuuuuuccucuauucuaagcugaccguggauaagucccgcuggcagcagggaaacguguuuagcugcucuguuaugcacgaagcccugcacaaccauuacacacaaaaaucccucagccugucucccgggaag

SEQ ID NO: 61655 - RNA, 636 nt, Artificial Sequence
  derived and/or modified sequence opt5 from CDS (LC) w/o signal peptide encoded by mRNA R3058, R3060
gacauccagcugacgcaaagccccgccauuauguccgcuucuccuggcgagaaggugacaaugacgugcagcgccuccucuagcgucggguacaugcacugguaucagcagaaauccucuaccagcccgaagcucuggaucuacgauacauccaaacuggcgagcggaguucccggcagauucucuggguccggaagcggcaacucuuauucccuuaccauuagcucuauccaggcugaagacguggccacauacuauuguuuucaaggguccggauacccuuucaccuuuggcggcgggacaaagcuggagauuaaaaccguggccgcucccagcgucuucaucuuuccucccuccgaugaacagcucaagucuggaacggccagcgugguuugccugcuuaauaacuucuauccucgggaggcuaaggugcaguggaaagucgacaaugcccugcaguccggcaacagccaagaaucugugaccgagcaggauuccaaggacagcacauacucucucagcuccacccugacacugucuaaagcggauuacgagaagcauaaaguuuaugccugugaagugacccaccaggggcucagcuccccggucaccaagagcuuuaaucgcggagagugc

SEQ ID NO: 61656 - RNA, 1302 nt, Artificial Sequence
  derived and/or modified sequence opt6 from CDS (HC) w/o signal peptide encoded by mRNA R3058, R3060
caaguagaacuccaagaaucagguccaggcaucuuacaaccaucccaaacauuaucacuaacaugcucauucucaggauucucacuaucaacaucaggcaugucaguuggauggauaagacaaccaucuggagaaggacuagaaugguuagcagauaucuggugggaugacaaaaaagacuauaacccaucauuaaaaucccgacuaaccauauccaaagacacauccucuaaccaaguuuucuuaaaaauuacaggagucgacacugcagauacugccaccuauuauugcgcaagauccaugauaacaaauugguauuucgauguauggggagcaggcacaacaguaacaguaucaucauccacaaaaggaccuucaguuuucccacucgcacccucaucaaaaucaaccuccggaggcacugcagcccuagguugccuaguaaaagacuacuuucccgaaccugucacaguaucguggaacucaggugcucuaacaucaggaguccacaccuuuccagcaguacuucaauccuccggacucuacucauuaucaucaguuguaaccguaccaucaucaucauuagguacccaaacauacauauguaauguaaaccauaaaccaagcaacaccaaagucgacaaaaaaguagaaccaaaaucuugcgauaaaacacacacaugcccacccugccccgccccagaacuacuaggaggaccaucaguauuccuauucccaccuaaacccaaagacacccuuaugauaucucgaacacccgaagucacguguguaguaguagacguaucacacgaagaccccgaaguaaaauucaauugguacgucgacggcguagaaguucacaacgcaaaaacaaaaccuagagaagaacaauauaacucaacauaucgcguaguaucaguccuaacaguacuacaccaagacugguuaaauggaaaagaauacaaaugcaaaguaucaaauaaagcacuuccagcacccauagaaaaaacaauaucaaaagcaaaaggucaaccaagagaaccucaaguauacacauuaccaccaucaagagaugaacuaacaaaaaaccaaguaucacuaacauguuuaguaaaagguuuuuacccaucugacauagcaguagaaugggaauccaacggacaacccgaaaauaauuacaaaaccacacccccaguauuagauuccgauggaucuuucuucuuauacucaaaauuaacuguagacaaaucaagauggcaacaagguaacguauuuucauguucagucaugcacgaagcacua

SEQ ID NO: 61657 - RNA, 636 nt, Artificial Sequence
  derived and/or modified sequence opt6 from CDS (LC) w/o signal peptide encoded by mRNA R3058, R3060
gacauacaacuaacacaaucaccagcaauaaugucagcaucaccaggagaaaaaguaacaaugacaugcucagcaagcucauccguaggauauaugcacugguaucaacaaaaaucaagcacaucaccaaaauuauggauauacgacacaucaaaauuagcaucaggaguaccaggacgcuuuagcggaucaggaagcggaaacucauacucucucacaauaucaucaauacaagccgaagacgucgcaacauauuacugcuuccaaggaucaggcuacccauucacauuuggcggaggaacaaaacuagaaauaaaaacaguagcagccccaagcguauucauauucccaccaucagacgaacaacuaaaaucaggaacagcaucaguaguuugccuacuaaauaacuucuacccaagagaagcaaaaguacaauggaaaguagacaacgcacuacaaucaggaaacucacaagaaucaguaacagaacaagacucaaaagauucaacauauucauuauccucaacacuaacuuuaucaaaagcagacuacgaaaaacacaaaguauacgcaugcgaaguaacacaccaaggacuaucauccccaguaacaaaaucauuuaacagaggagaaugc

SEQ ID NO: 61658 - RNA, 1347 nt, Artificial Sequence
  derived and/or modified sequence opt11 from CDS (HC) w/o signal peptide encoded by mRNA R3058, R3060
caagucgaacuccaagaaagcggccccggcauccuccagcccucccaaacccuuucccuaaccugcucauucuccggcuucucccucuccacuuccggcauguccguaggauggaucagacaacccuccggugagggccucgaauggcuugccgacauauggugggacgacaagaaagacuacaaccccucccugaaaucccgccuaaccaucuccaaagacacauccucaaaccaggucuuccucaaaauaaccggcgucgacaccgccgacaccgccaccuacuacugcgcacgcuccaugauaacaaacugguacuucgacgucuggggugccggcacaaccgucaccgucuccucauccacuaaaggccccuccgucuucccacucgccccauccuccaaauccacuuccggcggcaccgccgcccucggcugccucgucaaagacuacuucccugaacccgucaccguaucuuggaacuccggggcacucaccagcgggguccacaccuucccggcaguacuccaguccucaggacucuacucccuauccucagucgucacaguccccuccuccucccucggaacccaaaccuauauaugcaacgucaaccacaaacccucaaacacaaaaguagacaagaaagucgaacccaaaucaugcgacaaaacacacacaugcccacccugccccgcacccgaacucuuaggaggcccuucagucuuccucuucccacccaaacccaaagacacccuaaugauaucccgaacccccgaaguaaccugcgucgucguagacguaucccacgaagacccagaagucaaauucaacugguacgucgacggcgucgaaguccacaacgccaaaaccaaaccccgggaagaacaauacaacucuaccuaccgagucgucucgguacucacaguacuccaccaagacuggcuaaacggaaaagaauacaaaugcaaagucuccaacaaagcacuccccgcucccaucgagaaaacaaucuccaaagccaaaggccaaccccgcgaaccccaagucuacacccucccacccucucgcgacgaacucaccaaaaaccaaguaucacuaaccugccucgucaaaggauuuuaccccucagacaucgccguagaaugggaauccaacggccagccagaaaacaacuacaaaaccaccccacccguucucgacucagacggcucauucuuccucuacuccaaacucaccguggacaaaucccgcuggcaacagggcaacguauucagcugcuccguaaugcacgaagcacuccacaaccacuacacacagaaaucucuaucccucucacccggaaaa

SEQ ID NO: 61659 - RNA, 636 nt, Artificial Sequence
  derived and/or modified sequence opt11 from CDS (LC) w/o signal peptide encoded by mRNA R3058, R3060
gacauccaacucacccaaucccccgccaucauguccgcaucccccggcgaaaaagucacaaugaccugcuccgccuccucauccgucggcuacaugcacugguaccaacaaaaaucauccaccucccccaaacuauggauauacgacacaucaaaacuggccuccggcguccccggacgcuucuccggcuccggcuccggcaacuccuacucccucacaaucuccagcauccaagccgaagacguagccaccuacuacugcuuccaaggcucaggcuaccccuucaccuucggcggaggcaccaaacuagaaaucaaaaccgucgccgcccccuccgucuucaucuucccccccucagacgaacaacuaaaauccggcaccgccuccgucguaugccugcucaacaacuucuacccccgcgaagccaaaguccaauggaaagucgacaacgcccuccaauccggcaacucacaagaauccgucaccgaacaagacuccaaagacuccaccuacucccuaucauccacccuaacccuauccaaagccgacuacgaaaaacacaaaguauacgccugcgaagucacccaccaaggccucagcucccccgucaccaaauccuucaaccgcggcgaaugc

SEQ ID NO: 61660 - protein, 474 aa, Artificial Sequence
  Protein (HC) encoded by mRNA R3058, R3060
MAVMAPRTLVLLLSGALALTQTWAGQVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61661 - protein, 237 aa, Artificial Sequence
  Protein (LC) encoded by mRNA R3058, R3060
MAVMAPRTLVLLLSGALALTQTWAGDIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61662 - RNA, 1425 nt, Artificial Sequence
  CDS (HC) encoded by mRNA R3058, R3060
auggccgugauggcgccgcggacccugguccuccugcugagcggcgcccucgcccugacgcagaccugggccgggcagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaaguga

SEQ ID NO: 61663 - RNA, 714 nt, Artificial Sequence
  CDS (LC) encoded by mRNA R3058, R3060
auggccgugauggcgccgcggacccugguccuccugcugagcggcgcccucgcccugacgcagaccugggccggggacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61664 - RNA, 2818 nt, Artificial Sequence
  CDS (HC)-IRES-CDS (LC) as RNA from mRNA R3058, R3060
auggccgugauggcgccgcggacccugguccuccugcugagcggcgcccucgcccugacgcagaccugggccgggcagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61665 - RNA, 3010 nt, Artificial Sequence
  R3058
gggagaaagcuuaccauggccgugauggcgccgcggacccugguccuccugcugagcggcgcccucgcccugacgcagaccugggccgggcagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag

SEQ ID NO: 61666 - RNA, 3200 nt, Artificial Sequence
  R3060
ggggcgcugccuacggagguggcagccaucuccuucucggcaucaagcuuaccauggccgugauggcgccgcggacccugguccuccugcugagcggcgcccucgcccugacgcagaccugggccgggcagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggcgccgcggacccugguccuccugcugagcggcgcccucgcccugacgcagaccugggccggggacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuagugcaucacauuuaaaagcaucucagccuaccaugagaauaagagaaagaaaaugaagaucaauagcuuauucaucucuuuuucuuuuucguugguguaaagccaacacccugucuaaaaaacauaaauuucuuuaaucauuuugccucuuuucucugugcuucaauuaauaaaaaauggaaagaaccuagaucuaaaaaaaaaaaaaaaaaaaaaaaaaaaaaaaaaaaaaaaaaaaaaaaaaaaaaaaaaaaaaaaaugcaucccccccccccccccccccccccccccccccaaaggcucuuuucagagccaccagaauu

SEQ ID NO: 61667 - protein, 450 aa, Artificial Sequence
  Protein (HC) w/o signal peptide encoded by mRNA R4179
QVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61668 - RNA, 1350 nt, Artificial Sequence
  CDS (HC) w/o signal peptide encoded by mRNA R4179
cagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccgccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaag

SEQ ID NO: 61669 - RNA, 1350 nt, Artificial Sequence
  derived and/or modified sequence opt2 from CDS (HC) w/o signal peptide encoded by mRNA R4179
caggucgagcuccaggaguccggccccggcauccuccagcccucccagacccucucccucaccugcuccuucuccggcuucucccucuccaccuccggcauguccgucggcuggauccgccagcccuccggcgagggccucgaguggcucgccgacaucuggugggacgacaagaaggacuacaaccccucccucaagucccgccucaccaucuccaaggacaccuccuccaaccaggucuuccucaagaucaccggcgucgacaccgccgacaccgccaccuacuacugcgcccgcuccaugaucaccaacugguacuucgacgucuggggcgccggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61670 - RNA, 1350 nt, Artificial Sequence
  derived and/or modified sequence opt3 from CDS (HC) w/o signal peptide encoded by mRNA R4179
cagguggagcugcaagaaagcggccccgggauccuccagccuucccagacccuuucucugacaugcucauucaguggauuuagcuuguccacuucugguaugucggucggcuggauuagacagccaucaggggagggauuagaauggcuggcugacauauggugggaugacaagaaagauuacaacccgagccuaaagaguaggcucacgaucuccaaagacaccucuagcaaucaaguuuuccugaagauuacaggcguggauacugcugacaccgcaacauauuacugugcccgguccaugaucaccaacugguauuuugauguauggggugcggggacuacagugaccgucucaagugcuagcacgaaaggacccucuguguucccucuugccccauccucaaagagcacaaguggcggcaccgcagcccuggggugcuugguuaaggacuacuuucccgagccugugacagucucuuggaacuccggagcucucacuagcggugugcacaccuucccagcaguacugcagucgucuggccuguauucccucucaaguguugugacaguccccagcuccucuuuagggacccagacguacauuuguaaugugaaucauaaaccuagcaacacuaagguggauaaaaaggucgaaccaaaaucaugcgacaagacacacaccuguccgcccugcccugccccagagcugcuuggaggccccaguguguuuuuguucccuccaaagcccaaagauacucugaugaucucccgcacaccggagguuaccuguguaguggucgacgugagccaugaagauccugagguuaaguuuaauugguauguggacggugucgaagugcacaacgcuaaaacgaagccccgagaggagcaguacaauucuaccuaccguguaguuucagugcuaacaguccuccaucaagacuggcugaacgggaaagaauauaagugcaaagugaguaauaaggcccuuccagcgccuauagagaagacuaucagcaaagcaaagggacagcccagagaaccacaggucuacacccugcccccuuccagggaugaguugacuaaaaaccaggugucucucacuugucugguuaagggcuucuauccaucggacauugccguggaaugggagagcaauggccaaccggagaacaauuacaaaaccacacccccuguauuagauuccgacgggucauuuuuccuguauaguaagcucaccgucgauaagucucgguggcagcagggaaacguguuuagcugcuccguuaugcacgaagcccuucacaaccauuacacucaaaaaucacugagcuugucuccagguaag

SEQ ID NO: 61671 - RNA, 1350 nt, Artificial Sequence
  derived and/or modified sequence opt4 from CDS (HC) w/o signal peptide encoded by mRNA R4179
cagguggagcugcaggagagcggccccggcauccugcagcccagccagacccugagccugaccugcagcuucagcggcuucagccugagcaccagcggcaugagcgugggcuggaucagacagcccagcggcgagggccuggaguggcuggccgacaucuggugggacgacaagaaggacuacaaccccagccugaagagcagacugaccaucagcaaggacaccagcagcaaccagguguuccugaagaucaccggcguggacaccgccgacaccgccaccuacuacugcgccagaagcaugaucaccaacugguacuucgacguguggggcgccggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61672 - RNA, 1350 nt, Artificial Sequence
  derived and/or modified sequence opt5 from CDS (HC) w/o signal peptide encoded by mRNA R4179
cagguggagcugcaagaaagcggccccgggauccuccagccuucccagacccugucucuuacaugcagcuucuccggauuuucucugagcacguccggcaugucugucggguggauuagacagccgagcggagagggccucgaauggcuggccgacaucuggugggaugacaagaaagauuacaaccccucccuuaagagccggcugaccauuucuaaagacacauccagcaaucaaguuuuccucaagaucaccgggguggauacagcugacaccgccacauauuacugugcgcgcucuaugauuaccaacugguauuuugauguguggggagcuggcacgaccgucacaguguccagcgccucuaccaaaggcccuuccguuuucccccuggccccuagcuccaagucuacaagcgggggaaccgcugcccugggcugccucgugaaggacuacuuucccgagccugucacgguguccuggaauagcggggcucugacaucuggaguucacaccuucccggccgugcuucaguccagcggccuguauucucucagcuccgucgugacagugcccucuagcucccuggggacccagaccuacaucuguaacgucaaucauaaaccuagcaacacaaagguugauaaaaagguggaacccaaaucuugcgacaagacgcacaccuguccucccugcccggcgccugagcuucugggaggccccuccguguuucucuucccucccaagcccaaagauacacugaugaucagcagaaccccugaggucacaugugugguuguggacgucucucaugaagauccggaggugaaguuuaauugguauguugacggcguggaaguccacaacgccaaaaccaagccccgggaggagcaguacaauuccacguaccgcguggucagcgugcugacaguucuccaucaagacuggcugaacgggaaagaauauaagugcaaaguguccaauaaggcccuuccugcucccauugagaagaccaucucuaaagcuaagggacagccuagagaaccccaggucuacacccugccgccuagccgggaugagcucaccaaaaaccaggugucccugacaugucuuguuaagggcuucuaucccucugacauugccguggaaugggagagcaaugggcaaccugagaacaauuacaaaacaacgcccccuguccuggauuccgacggcagcuuuuuccucuauucuaagcugaccguggauaagucccgcuggcagcagggaaacguguuuagcugcucuguuaugcacgaagcgcugcacaaccauuacacacaaaaaucccucagccugucucccgggaag

SEQ ID NO: 61673 - RNA, 1350 nt, Artificial Sequence
  derived and/or modified sequence opt6 from CDS (HC) w/o signal peptide encoded by mRNA R4179
caaguagaacuccaagaaucaggaccagguauccuacaacccucucaaacauuaucacuaaccugcucauucucaggauucucacuaucaacaucaggaaugucuguaggcuggauaagacaaccaucaggcgaaggacuagaauggcucgcagacaucuggugggaugauaaaaaagacuauaauccuucacuaaaaucucgauuaaccaucucaaaagacacgucaucuaaccaaguauucuuaaaaauaacaggaguagauacagcagacacugccacauacuauugcgcacgaucaaugauaacaaacugguacuucgacgucuggggcgcaggaacaacaguaacaguuucaagugccucaacaaaagguccauccguauucccauuagcaccaucuucaaaaucuacaucaggaggaacagcagcacucggcugucuagucaaagacuacuuucccgaaccaguaacaguaucauggaauucuggagcucuaacaucaggcguacacacauuuccagcuguucuacaaucaucaggauuauacucacuuucaucagucguaacaguaccaucaucuucucuaggaacacaaacuuacauaugcaacguaaaccauaaacccucaaauacaaaaguugacaaaaaaguagaaccaaaauccugcgauaaaacacauacaugcccuccauguccagcaccagaacuccuaggaggaccaucaguauuccuauuccccccuaaaccaaaagacacauuaaugauaucuagaacaccagaaguaacaugcguaguaguagauguaucccacgaagacccagaagucaaauuuaacugguacguugacggaguagaaguacacaacgcaaaaacaaaaccacgagaagaacaauacaacucaacguacagaguaguaucaguacuaacaguauuacaucaagacuggcuuaacggaaaagaauauaaauguaaagucucaaacaaagcacuucccgccccaauagaaaaaacgauaucaaaagcaaaaggacaaccaagagaaccacaaguauacacacuucccccaagccgcgacgaacuaaccaaaaaccaaguaucucuaaccugucucguaaaaggauucuacccaucagacauagcagucgagugggaaucaaacggacaaccugaaaauaacuacaaaacaacaccaccaguccuagauucagauggaucauucuuccuauacucaaaauuaacaguagauaaaucaagauggcaacaaggaaauguauuuaguuguucaguaaugcacgaagcacuacacaaccacuacacacaaaaaucacucucacucucaccaggaaaa

SEQ ID NO: 61674 - RNA, 1350 nt, Artificial Sequence
  derived and/or modified sequence opt11 from CDS (HC) w/o signal peptide encoded by mRNA R4179
caaguugaacuccaggaauccggccccggcauccuucaaccgucucaaacccucucccucaccuguuccuucuccggcuucucccuguccaccucaggcauguccguaggcuggauccgccaacccucgggagaaggccucgaauggcucgcagacaucuggugggaugacaaaaaagacuacaaucccucacuuaaaucacgccucaccaucuccaaagacaccuccuccaaccaaguauuccucaaaaucacaggagucgacacggcagacaccgccaccuacuacugcgcccgcuccaugauaacuaacugguacuucgacgucuggggcgccggcaccaccgucaccgucucauccgccuccaccaaaggacccuccguauucccucuagcacccucauccaaauccacauccggaggcaccgcagcccucggcugccucgucaaagacuacuuccccgaaccagucacggucucauggaacuccggcgcccucacauccggcguccacacauuccccgccguccuccaaucauccggccucuacagccucuccucugucguaaccguccccuccuccucacucggcacacaaaccuacauuugcaacgucaaccacaaaccuuccaacaccaaagucgacaaaaaagucgaacccaaaucaugcgacaaaacacacacaugcccucccugcccugcccccgaacuccuaggcggccccucuguauuccucuucccacccaaacccaaagauacacucaugaucucccgcacccccgagguaacgugcgucgucgucgacgucucccacgaagaccccgaaguaaaauucaacugguacgucgacggaguagaaguccacaacgcaaaaaccaaaccccgugaagaacaauacaacuccaccuaccgaguagucagcguccucaccguacuccaccaggacuggcuaaauggaaaagaauacaaaugcaaagucuccaacaaagcccucccagcacccauugaaaaaacuauaagcaaagcaaaaggccaaccccgcgaaccccaagucuacacccucccccccucccgcgaugaacucacaaaaaaccaaguuucccuaaccugccucgucaagggauucuaccccuccgacauagccgucgaaugggaaucaaauggccaacccgaaaacaacuacaaaaccaccccccccguacuagacucagacggcuccuucuuccucuacuccaaacucacgguagacaaaagcagauggcaacaaggcaacgucuuuucgugcuccgucaugcacgaagcacuucacaaccacuacacucaaaaaucccugucccuauccccaggcaaa

SEQ ID NO: 61675 - protein, 469 aa, Artificial Sequence
  Protein (HC) encoded by mRNA R4179
MELGLSWIFLLAILKGVQCQVELQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61676 - RNA, 1410 nt, Artificial Sequence
  CDS (HC) encoded by mRNA R4179
auggagcugggccucagcuggaucuuccugcuggccauccucaagggggugcagugccagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccgccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaaguga

SEQ ID NO: 61677 - RNA, 1614 nt, Artificial Sequence
  R4179
gggagaaagcuuaccauggagcugggccucagcuggaucuuccugcuggccauccucaagggggugcagugccagguggagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccgccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61678 - protein, 450 aa, Artificial Sequence
  Protein (HC) w/o signal peptide encoded by mRNA R4180
EVQLQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61679 - RNA, 1350 nt, Artificial Sequence
  CDS (HC) w/o signal peptide encoded by mRNA R4180
gaggugcagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccgccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaag

SEQ ID NO: 61680 - RNA, 1350 nt, Artificial Sequence
  derived and/or modified sequence opt2 from CDS (HC) w/o signal peptide encoded by mRNA R4180
gagguccagcuccaggaguccggccccggcauccuccagcccucccagacccucucccucaccugcuccuucuccggcuucucccucuccaccuccggcauguccgucggcuggauccgccagcccuccggcgagggccucgaguggcucgccgacaucuggugggacgacaagaaggacuacaaccccucccucaagucccgccucaccaucuccaaggacaccuccuccaaccaggucuuccucaagaucaccggcgucgacaccgccgacaccgccaccuacuacugcgcccgcuccaugaucaccaacugguacuucgacgucuggggcgccggcaccaccgucaccgucuccuccgccuccaccaagggccccuccgucuucccccucgcccccuccuccaaguccaccuccggcggcaccgccgcccucggcugccucgucaaggacuacuuccccgagcccgucaccgucuccuggaacuccggcgcccucaccuccggcguccacaccuuccccgccguccuccaguccuccggccucuacucccucuccuccgucgucaccguccccuccuccucccucggcacccagaccuacaucugcaacgucaaccacaagcccuccaacaccaaggucgacaagaaggucgagcccaaguccugcgacaagacccacaccugcccccccugccccgcccccgagcuccucggcggccccuccgucuuccucuucccccccaagcccaaggacacccucaugaucucccgcacccccgaggucaccugcgucgucgucgacgucucccacgaggaccccgaggucaaguucaacugguacgucgacggcgucgagguccacaacgccaagaccaagccccgcgaggagcaguacaacuccaccuaccgcgucgucuccguccucaccguccuccaccaggacuggcucaacggcaaggaguacaagugcaaggucuccaacaaggcccuccccgcccccaucgagaagaccaucuccaaggccaagggccagccccgcgagccccaggucuacacccucccccccucccgcgacgagcucaccaagaaccaggucucccucaccugccucgucaagggcuucuaccccuccgacaucgccgucgagugggaguccaacggccagcccgagaacaacuacaagaccaccccccccguccucgacuccgacggcuccuucuuccucuacuccaagcucaccgucgacaagucccgcuggcagcagggcaacgucuucuccugcuccgucaugcacgaggcccuccacaaccacuacacccagaagucccucucccucucccccggcaag

SEQ ID NO: 61681 - RNA, 1350 nt, Artificial Sequence
  derived and/or modified sequence opt3 from CDS (HC) w/o signal peptide encoded by mRNA R4180
gaggugcagcugcaagaaagcggccccgggauccuccagccuucccagacccuuucucugacaugcucauucaguggauuuagcuuguccacuucugguaugucggucggcuggauuagacagccaucaggggagggauuagaauggcuggcugacauauggugggaugacaagaaagauuacaacccgagccuaaagaguaggcucacgaucuccaaagacaccucuagcaaucaaguuuuccugaagauuacaggcguggauacugcugacaccgcaacauauuacugugcccgguccaugaucaccaacugguauuuugauguauggggugcggggacuacagugaccgucucaagugcuagcacgaaaggacccucuguguucccucuugccccauccucaaagagcacaaguggcggcaccgcagcccuggggugcuugguuaaggacuacuuucccgagccugugacagucucuuggaacuccggagcucucacuagcggugugcacaccuucccagcaguacugcagucgucuggccuguauucccucucaaguguugugacaguccccagcuccucuuuagggacccagacguacauuuguaaugugaaucauaaaccuagcaacacuaagguggauaaaaaggucgaaccaaaaucaugcgacaagacacacaccuguccgcccugcccugccccagagcugcuuggaggccccaguguguuuuuguucccuccaaagcccaaagauacucugaugaucucccgcacaccggagguuaccuguguaguggucgacgugagccaugaagauccugagguuaaguuuaauugguauguggacggugucgaagugcacaacgcuaaaacgaagccccgagaggagcaguacaauucuaccuaccguguaguuucagugcuaacaguccuccaucaagacuggcugaacgggaaagaauauaagugcaaagugaguaauaaggcccuuccagcgccuauagagaagacuaucagcaaagcaaagggacagcccagagaaccacaggucuacacccugcccccuuccagggaugaguugacuaaaaaccaggugucucucacuugucugguuaagggcuucuauccaucggacauugccguggaaugggagagcaauggccaaccggagaacaauuacaaaaccacacccccuguauuagauuccgacgggucauuuuuccuguauaguaagcucaccgucgauaagucucgguggcagcagggaaacguguuuagcugcuccguuaugcacgaagcccuucacaaccauuacacucaaaaaucacugagcuugucuccagguaag

SEQ ID NO: 61682 - RNA, 1350 nt, Artificial Sequence
  derived and/or modified sequence opt4 from CDS (HC) w/o signal peptide encoded by mRNA R4180
gaggugcagcugcaggagagcggccccggcauccugcagcccagccagacccugagccugaccugcagcuucagcggcuucagccugagcaccagcggcaugagcgugggcuggaucagacagcccagcggcgagggccuggaguggcuggccgacaucuggugggacgacaagaaggacuacaaccccagccugaagagcagacugaccaucagcaaggacaccagcagcaaccagguguuccugaagaucaccggcguggacaccgccgacaccgccaccuacuacugcgccagaagcaugaucaccaacugguacuucgacguguggggcgccggcaccaccgugaccgugagcagcgccagcaccaagggccccagcguguucccccuggcccccagcagcaagagcaccagcggcggcaccgccgcccugggcugccuggugaaggacuacuuccccgagcccgugaccgugagcuggaacagcggcgcccugaccagcggcgugcacaccuuccccgccgugcugcagagcagcggccuguacagccugagcagcguggugaccgugcccagcagcagccugggcacccagaccuacaucugcaacgugaaccacaagcccagcaacaccaagguggacaagaagguggagcccaagagcugcgacaagacccacaccugcccccccugccccgcccccgagcugcugggcggccccagcguguuccuguucccccccaagcccaaggacacccugaugaucagcagaacccccgaggugaccugcguggugguggacgugagccacgaggaccccgaggugaaguucaacugguacguggacggcguggaggugcacaacgccaagaccaagcccagagaggagcaguacaacagcaccuacagaguggugagcgugcugaccgugcugcaccaggacuggcugaacggcaaggaguacaagugcaaggugagcaacaaggcccugcccgcccccaucgagaagaccaucagcaaggccaagggccagcccagagagccccagguguacacccugccccccagcagagacgagcugaccaagaaccaggugagccugaccugccuggugaagggcuucuaccccagcgacaucgccguggagugggagagcaacggccagcccgagaacaacuacaagaccaccccccccgugcuggacagcgacggcagcuucuuccuguacagcaagcugaccguggacaagagcagauggcagcagggcaacguguucagcugcagcgugaugcacgaggcccugcacaaccacuacacccagaagagccugagccugagccccggcaag

SEQ ID NO: 61683 - RNA, 1350 nt, Artificial Sequence
  derived and/or modified sequence opt5 from CDS (HC) w/o signal peptide encoded by mRNA R4180
gaggugcagcugcaagaaagcggccccgggauccuccagccuucccagacccugucucuuacaugcagcuucuccggauuuucucugagcacguccggcaugucugucggguggauuagacagccgagcggagagggccucgaauggcuggccgacaucuggugggaugacaagaaagauuacaaccccucccuuaagagccggcugaccauuucuaaagacacauccagcaaucaaguuuuccucaagaucaccgggguggauacagcugacaccgccacauauuacugugcgcgcucuaugauuaccaacugguauuuugauguguggggagcuggcacgaccgucacaguguccagcgccucuaccaaaggcccuuccguuuucccccuggccccuagcuccaagucuacaagcgggggaaccgcugcccugggcugccucgugaaggacuacuuucccgagccugucacgguguccuggaauagcggggcucugacaucuggaguucacaccuucccggccgugcuucaguccagcggccuguauucucucagcuccgucgugacagugcccucuagcucccuggggacccagaccuacaucuguaacgucaaucauaaaccuagcaacacaaagguugauaaaaagguggaacccaaaucuugcgacaagacgcacaccuguccucccugcccggcgccugagcuucugggaggccccuccguguuucucuucccucccaagcccaaagauacacugaugaucagcagaaccccugaggucacaugugugguuguggacgucucucaugaagauccggaggugaaguuuaauugguauguugacggcguggaaguccacaacgccaaaaccaagccccgggaggagcaguacaauuccacguaccgcguggucagcgugcugacaguucuccaucaagacuggcugaacgggaaagaauauaagugcaaaguguccaauaaggcccuuccugcucccauugagaagaccaucucuaaagcuaagggacagccuagagaaccccaggucuacacccugccgccuagccgggaugagcucaccaaaaaccaggugucccugacaugucuuguuaagggcuucuaucccucugacauugccguggaaugggagagcaaugggcaaccugagaacaauuacaaaacaacgcccccuguccuggauuccgacggcagcuuuuuccucuauucuaagcugaccguggauaagucccgcuggcagcagggaaacguguuuagcugcucuguuaugcacgaagcgcugcacaaccauuacacacaaaaaucccucagccugucucccgggaag

SEQ ID NO: 61684 - RNA, 1350 nt, Artificial Sequence
  derived and/or modified sequence opt6 from CDS (HC) w/o signal peptide encoded by mRNA R4180
gaaguacaacuacaagaaucaggacccggcauccugcaaccaucacaaacauuaucacuaacaugcucauucucaggauucucacuuucuaccucaggaauguccgucgguuggauaagacaaccaucaggagaaggacuagaaugguuagcagacauauggugggacgacaaaaaagacuacaacccauccuuaaaaucuagauuaacaauaucuaaagauacaucaucaaaucaaguauucuuaaaaaucacuggaguggacacagccgacacugcaacauacuauugcgccagaucaaugauaacaaacugguauuucgacgucuggggagcaggaaccaccguaacaguauccuccgcauccaccaaaggaccauccguauucccacuugcccccuccucaaaaaguacaucugguggaacagcagcacuaggaugcuuagucaaagacuacuuucccgaaccaguaacaguuuccuggaacucaggagcauuaacaucaggcguacacacauucccagcaguccuacaaagcucaggacucuacucacuuucauccguaguuacaguuccauccucuucccuaggaacacaaacuuacauauguaacguaaaccauaaaccaucaaauacaaaaguagauaaaaaaguagaaccaaaauccugcgacaaaacacauacauguccaccauguccagcaccagaacuacuaggaggaccaucaguauuccuauucccaccuaaaccaaaagacacacuaaugauauccagaacaccagaaguaacaugcguaguuguagacguaucacacgaagauccagaaguaaaauucaauugguacguagacggagucgaaguacacaaugcaaaaacaaaaccacgugaagaacaauacaacucuacauacagaguaguaucaguccuaacaguauuacaccaagacuggcuaaacgguaaagaauacaaaugcaaagucucaaacaaagcauuaccagcaccaauagaaaaaacaauaucaaaagcuaaaggacaaccaagagaaccacaaguauacacccuacccccaucaagagacgaauuaacaaaaaaccaaguaucucuuacaugcuuaguaaaagguuuuuacccauccgacauagcaguagaaugggaaucgaacggccaacccgaaaacaauuacaaaacaacaccaccaguccucgauucagacgguucauucuuccuuuacuccaaacuuacagucgacaaaaguagauggcaacaaggaaacguauucagcuguucagucaugcacgaagcccuacauaaccacuacacacaaaaaucacuaucccuaagccccggcaaa

SEQ ID NO: 61685 - RNA, 1350 nt, Artificial Sequence
  derived and/or modified sequence opt11 from CDS (HC) w/o signal peptide encoded by mRNA R4180
gaagugcagcuccaagaauccggucccggcauacuacaacccagccaaacccuuucccuaaccugcagcuucuccggcuucucucuuuccaccuccggcaugagcgucggcuggauccgccaaccauccggcgaaggacucgaauggcucgccgauaucuggugggacgacaagaaagacuacaaccccucccucaaauccagacucacaauuuccaaagacacauccuccaaccaagucuuucucaaaaucaccggcgucgacaccgcggacaccgccacauacuacugcgcccgcucaaugaucacaaacugguacuucgacgucuggggcgccggcacgacugucaccgucucgagcgcaucgaccaaaggaccaucagucuucccacuggccccauccuccaaaucaacauccggcggaaccgccgcacucggcugccucgucaaagacuacuucccagaacccgucaccgucuccuggaacuccggcgcccucaccucugguguccacacuuuccccgccguccuacaauccuccggacuauauucacucucauccgucgucaccguccccuccucaucacucggcacacaaaccuacaucugcaacgucaaccacaaaccaucuaacaccaaaguugacaagaaaguagaacccaaauccugcgacaaaacucacaccugucccccaugccccgcucccgaacuccucggaggccccucaguauuccuauucccacccaaacccaaagacacccucaugauaucccgaaccccagaaguuacaugcgucguagucgacgucagccacgaagaccccgaagucaaauuuaacugguacgucgacggagucgaaguccacaacgcuaaaacuaaaccucgcgaagaacaauacaacuccaccuaccgggucguauccguccucacuguccugcaccaagacuggcucaacggcaaagaauacaaaugcaaagucucaaacaaagcacugcccgcccccaucgagaaaaccaucuccaaagccaaaggccaaccccgcgaaccccaagucuacacacuaccaccaucccgcgacgaacucaccaaaaaccaagucagccuaacaugccucgucaaaggcuucuaccccuccgacaucgccguagaaugggaauccaacggccaaccagaaaacaacuacaaaaccaccccacccguccucgacucagacggcuccuucuuccucuauuccaaacucaccguagacaaguccagauggcaacaaggcaacgucuucuccugcuccgucaugcacgaagcacuccacaaccacuacacccagaaaucucucucccucucacccggcaaa

SEQ ID NO: 61686 - protein, 469 aa, Artificial Sequence
  Protein (HC) encoded by mRNA R4180
MELGLSWIFLLAILKGVQCEVQLQESGPGILQPSQTLSLTCSFSGFSLSTSGMSVGWIRQPSGEGLEWLADIWWDDKKDYNPSLKSRLTISKDTSSNQVFLKITGVDTADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61687 - RNA, 1410 nt, Artificial Sequence
  CDS (HC) encoded by mRNA R4180
auggagcugggccucagcuggaucuuccugcuggccauccucaagggggugcagugcgaggugcagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccgccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaaguga

SEQ ID NO: 61688 - RNA, 1614 nt, Artificial Sequence
  R4180
gggagaaagcuuaccauggagcugggccucagcuggaucuuccugcuggccauccucaagggggugcagugcgaggugcagcugcaggagagcggccccgggauccuccagccgucccagacccugagccugaccugcuccuucagcggcuucucccucagcacguccgggaugagcgucggcuggauccgccagcccuccggggagggccuggaguggcuggccgacaucuggugggacgacaagaaggacuacaaccccagccucaagucccggcugaccaucagcaaggacaccuccagcaaccagguguuccugaagaucaccggcguggacacggccgacaccgcgaccuacuacugcgcccgcuccaugaucaccaacugguacuucgacguguggggcgccgggacgaccgugaccgugagcuccgccagcaccaagggccccuccguguucccgcuggcccccagcuccaagagcaccuccgggggcacggccgcgcucgggugccuggucaaggacuacuuccccgagcccgugaccgugagcuggaacuccggcgcccugaccagcgggguccacaccuucccggccgugcuccaguccagcggccuguacucccugagcuccguggucacggugcccagcuccagccucggcacccagaccuacaucugcaacgugaaccacaagcccuccaacaccaaggucgacaagaagguggagcccaagagcugcgacaagacgcacaccugcccgcccugccccgcccccgagcugcugggcgggccguccguguuccucuucccucccaagcccaaggacacccugaugaucagccgcaccccggaggucacgugcgugguggucgacgugagccacgaggaccccgaggugaaguucaacugguacgucgacgggguggaggugcacaacgccaagaccaagccccgggaggagcaguacaacuccaccuaccgcgucgugagcgugcugaccguccuccaccaggacuggcugaacggcaaggaguacaagugcaagguguccaacaaggcgcugcccgccccgaucgagaagacgaucagcaaggccaaggggcagccccgggagccccaggucuacacccucccgccgucccgcgacgagcugaccaagaaccaggugagccugaccugccucgugaagggcuucuaccccuccgacaucgccgucgagugggagagcaacggccagccggagaacaacuacaagacgaccccuccggugcuggacuccgacgggagcuucuuccuguacuccaagcucaccguggacaagagccgguggcagcagggcaacgucuucuccugcagcgugaugcacgaggcgcugcacaaccacuacacccagaagucccugagccucucccccgggaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61689 - protein, 213 aa, Artificial Sequence
  Protein (LC) w/o signal peptide encoded by mRNA R4181
DIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61690 - RNA, 639 nt, Artificial Sequence
  CDS (LC) w/o signal peptide encoded by mRNA R4181
gacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugc

SEQ ID NO: 61691 - RNA, 639 nt, Artificial Sequence
  derived and/or modified sequence opt2 from CDS (LC) w/o signal peptide encoded by mRNA R4181
gacauccagcucacccagucccccgccaucauguccgccucccccggcgagaaggucaccaugaccugcuccgccuccuccuccgucggcuacaugcacugguaccagcagaaguccuccaccucccccaagcucuggaucuacgacaccuccaagcucgccuccggcguccccggccgcuucuccggcuccggcuccggcaacuccuacucccucaccaucuccuccauccaggccgaggacgucgccaccuacuacugcuuccagggcuccggcuaccccuucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61692 - RNA, 639 nt, Artificial Sequence
  derived and/or modified sequence opt3 from CDS (LC) w/o signal peptide encoded by mRNA R4181
gacauccagcugacccaaagccccgccauuauguccgcuucuccuggcgagaaggugacaaugacuugcucagcaaguagcuccgucggguacaugcacugguaucagcagaaaucuucgacgucaccaaagcucuggauauacgauaccagcaaacuugccaguggaguuccggguagauucuccggcucugggagcggaaacuccuauucacugacaaucaguagcauucaggcggaagacguggcuacuuacuauuguuuucaaggcucugguuaccccuucaccuuugggggaggcacaaaguuggagaucaaaaggaccguagccgcaccuuccguguucauuuuuccacccucagaugaacaguuaaagagcggcacugccagugucgugugccugcuaaauaacuucuauccucgggaggcuaagguucaguggaaaguggacaaugcacuccagucugggaacucccaagaaagcgucacagagcaggauucgaaggacucuaccuacucccugucaaguacgcuuacucugagcaaagccgauuacgagaagcauaaaguguaugcuugugaaguaacccaccagggauuguccucuccaguuacaaagagcuuuaaucgcggugagugc

SEQ ID NO: 61693 - RNA, 639 nt, Artificial Sequence
  derived and/or modified sequence opt4 from CDS (LC) w/o signal peptide encoded by mRNA R4181
gacauccagcugacccagagccccgccaucaugagcgccagccccggcgagaaggugaccaugaccugcagcgccagcagcagcgugggcuacaugcacugguaccagcagaagagcagcaccagccccaagcuguggaucuacgacaccagcaagcuggccagcggcgugcccggcagauucagcggcagcggcagcggcaacagcuacagccugaccaucagcagcauccaggccgaggacguggccaccuacuacugcuuccagggcagcggcuaccccuucaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61694 - RNA, 639 nt, Artificial Sequence
  derived and/or modified sequence opt5 from CDS (LC) w/o signal peptide encoded by mRNA R4181
gacauccagcugacgcaaagccccgccauuauguccgcuucuccuggcgagaaggugacaaugacgugcagcgccuccucuagcgucggguacaugcacugguaucagcagaaauccucuaccagcccgaagcucuggaucuacgauacauccaaacuggcgagcggaguucccggcagauucucuggguccggaagcggcaacucuuauucccuuaccauuagcucuauccaggcugaagacguggccacauacuauuguuuucaaggguccggauacccuuucaccuuuggcggcgggacaaagcuggagauuaaacggaccguggccgcucccagcgucuucaucuuuccucccuccgaugaacagcucaagucuggaacggccagcgugguuugccugcuuaauaacuucuauccucgcgaggcuaaggugcaguggaaagucgacaaugcccugcaguccggcaacagccaagaaucugugaccgagcaggauuccaaggacagcacauacucucucagcuccacccugacacugucuaaagcggauuacgagaagcauaaaguuuaugccugugaagugacccaccaggggcucagcuccccggucaccaagagcuuuaauagaggagagugc

SEQ ID NO: 61695 - RNA, 639 nt, Artificial Sequence
  derived and/or modified sequence opt6 from CDS (LC) w/o signal peptide encoded by mRNA R4181
gacauacaacuaacacaaagcccagcaauaaugucagcaucaccaggagaaaaaguaacaaugacaugcucagcaucaucaucaguaggauacaugcacugguaccaacaaaaaucaucaacaucaccaaaacuauggauauacgauacaucaaaauuagcauccggaguaccaggaagauuuucaggauccggaucaggaaacuccuacucacuaacaauaucaucaauacaagcagaagacguagcaacauacuacugcuuccaaggauccggauacccauuuacauucggaggaggaacaaaauuagaaauaaaaagaacaguagcagcaccaucaguauucauauucccaccaucagacgaacaacuaaaaucaggaacagcaucaguaguaugccuacuaaacaauuucuacccacgagaagcaaaaguacaauggaaaguagacaacgcacuacaaucaggaaacucccaagaaucaguaacagaacaagacucaaaagacucaaccuacucacuaucaucaacacuaacacuaucaaaagcagacuaugaaaaacacaaaguauacgcaugcgaaguaacacaccaaggacuauccucacccguaacaaaaucauuuaauagaggcgaaugc

SEQ ID NO: 61696 - RNA, 639 nt, Artificial Sequence
  derived and/or modified sequence opt11 from CDS (LC) w/o signal peptide encoded by mRNA R4181
gacauacaacucacccaaucccccgccaucaugucagccucacccggcgaaaaagucaccaugaccugcucagccuccuccucaguaggcuacaugcacugguaccaacaaaaauccucaaccucccccaaacucuggaucuacgacaccuccaaacucgccucuggcguacccggccgcuucucaggcucaggcucaggcaacuccuacucccucaccaucuccucuauccaagccgaagacgucgccaccuacuacugcuuccaaggcuccggcuaccccuucaccuucggcggcggaaccaaacucgaaaucaaacgcaccgucgccgcacccuccgucuucaucuucccccccuccgacgaacaacucaaauccggcaccgccuccgucgucugccuacucaacaacuucuacccccgcgaagccaaaguccaauggaaagucgacaacgcccuucaaucuggcaacucccaagaaucagucaccgaacaagacuccaaagacuccaccuacucccucuccuccacccucacccucuccaaagccgacuacgaaaaacacaaagucuacgccugcgaagucacacaccaaggccuauccucccccgucaccaaauccuucaaccgcggugaaugc

SEQ ID NO: 61697 - protein, 233 aa, Artificial Sequence
  Protein (LC) encoded by mRNA R4181
METPAQLLFLLLLWLPDTTGDIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61698 - RNA, 702 nt, Artificial Sequence
  CDS (LC) encoded by mRNA R4181
auggagacccccgcccagcugcucuuccugcugcuccuguggcugccggacaccacgggcgacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61699 - RNA, 906 nt, Artificial Sequence
  R4181
gggagaaagcuuaccauggagacccccgcccagcugcucuuccugcugcuccuguggcugccggacaccacgggcgacauccagcugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61700 - protein, 213 aa, Artificial Sequence
  Protein (LC) w/o signal peptide encoded by mRNA R4182
DIVLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61701 - RNA, 639 nt, Artificial Sequence
  CDS (LC) w/o signal peptide encoded by mRNA R4182
gacaucguccugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugc

SEQ ID NO: 61702 - RNA, 639 nt, Artificial Sequence
  derived and/or modified sequence opt2 from CDS (LC) w/o signal peptide encoded by mRNA R4182
gacaucguccucacccagucccccgccaucauguccgccucccccggcgagaaggucaccaugaccugcuccgccuccuccuccgucggcuacaugcacugguaccagcagaaguccuccaccucccccaagcucuggaucuacgacaccuccaagcucgccuccggcguccccggccgcuucuccggcuccggcuccggcaacuccuacucccucaccaucuccuccauccaggccgaggacgucgccaccuacuacugcuuccagggcuccggcuaccccuucaccuucggcggcggcaccaagcucgagaucaagcgcaccgucgccgcccccuccgucuucaucuucccccccuccgacgagcagcucaaguccggcaccgccuccgucgucugccuccucaacaacuucuacccccgcgaggccaagguccaguggaaggucgacaacgcccuccaguccggcaacucccaggaguccgucaccgagcaggacuccaaggacuccaccuacucccucuccuccacccucacccucuccaaggccgacuacgagaagcacaaggucuacgccugcgaggucacccaccagggccucuccucccccgucaccaaguccuucaaccgcggcgagugc

SEQ ID NO: 61703 - RNA, 639 nt, Artificial Sequence
  derived and/or modified sequence opt3 from CDS (LC) w/o signal peptide encoded by mRNA R4182
gacaucgugcugacccagagccccgccauuauguccgcuucuccuggcgagaaggucacaaugacuugcucagcaaguagcuccguuggguacaugcacugguaucaacagaaaucuucgacgucaccaaagcucuggauauacgauaccagcaaacuugccaguggagugccggguagauucuccggcucugggagcggaaacuccuauucacugacaaucaguagcauucaggcggaagacguagcuacuuacuauuguuuucagggcucugguuaccccuucaccuuugggggaggcacaaaguuggagaucaaaaggaccguggccgcaccuuccgucuucauuuuuccacccucagaugaacaauuaaagagcggcacugccagugugguuugccugcuaaauaacuucuauccucgggaggcuaaggugcaguggaaagucgacaaugcacuccagucugggaacucccaggaaagcgugacagagcaagauucgaaggacucuaccuacucccugucaaguacgcuuacucugagcaaagccgauuacgagaagcauaaaguauaugcuugugaaguuacccaccagggauuguccucuccagugacaaagagcuuuaaucgcggugagugc

SEQ ID NO: 61704 - RNA, 639 nt, Artificial Sequence
  derived and/or modified sequence opt4 from CDS (LC) w/o signal peptide encoded by mRNA R4182
gacaucgugcugacccagagccccgccaucaugagcgccagccccggcgagaaggugaccaugaccugcagcgccagcagcagcgugggcuacaugcacugguaccagcagaagagcagcaccagccccaagcuguggaucuacgacaccagcaagcuggccagcggcgugcccggcagauucagcggcagcggcagcggcaacagcuacagccugaccaucagcagcauccaggccgaggacguggccaccuacuacugcuuccagggcagcggcuaccccuucaccuucggcggcggcaccaagcuggagaucaagagaaccguggccgcccccagcguguucaucuucccccccagcgacgagcagcugaagagcggcaccgccagcguggugugccugcugaacaacuucuaccccagagaggccaaggugcaguggaagguggacaacgcccugcagagcggcaacagccaggagagcgugaccgagcaggacagcaaggacagcaccuacagccugagcagcacccugacccugagcaaggccgacuacgagaagcacaagguguacgccugcgaggugacccaccagggccugagcagccccgugaccaagagcuucaacagaggcgagugc

SEQ ID NO: 61705 - RNA, 639 nt, Artificial Sequence
  derived and/or modified sequence opt5 from CDS (LC) w/o signal peptide encoded by mRNA R4182
gacaucgugcugacgcagagccccgccauuauguccgcuucuccuggcgagaaggucacaaugacgugcagcgccuccucuagcguuggguacaugcacugguaucaacagaaauccucuaccagcccgaagcucuggaucuacgauacauccaaacuggcgagcggagugcccggcagauucucuggguccggaagcggcaacucuuauucccuuaccauuagcucuauccaggcugaagacguggccacauacuauuguuuucagggguccggauacccuuucaccuuuggcggcgggacaaagcuggagauuaaacggaccgucgccgcucccagcguguucaucuuuccucccuccgaugaacaacucaagucuggaacggccagcguugugugccugcuuaauaacuucuauccucgcgaggcuaagguccaguggaaaguggacaaugcccugcaguccggcaacagccaggaaucuguuaccgagcaagauuccaaggacagcacauacucucucagcuccacccugacacugucuaaagcggauuacgagaagcauaaaguguaugccugugaagucacccaccaggggcucagcuccccggugaccaagagcuuuaauagaggagagugc

SEQ ID NO: 61706 - RNA, 639 nt, Artificial Sequence
  derived and/or modified sequence opt6 from CDS (LC) w/o signal peptide encoded by mRNA R4182
gacauaguccuaacacaauccccagccauaaugucagcaucaccaggagaaaaaguuacaaugacaugcucagcaucaucaucaguaggauacaugcacugguaccaacaaaaaucaucaacaucaccaaaacuauggauauacgacacaucaaaacuagcaucaggaguaccaggacgauucucaggaucaggaucagguaacucauacucacuaacaauaucaucaauacaagcagaagauguagcaacauauuacugcuuccaaggaucaggauaccccuucacauucggaggaggaacaaaacuagaaauaaaaagaacaguagcagccccaucaguauucauauucccaccaucagacgaacaacuaaaaucaggaaccgcaucaguaguaugccuacuaaacaacuuuuacccaagagaagcaaaaguacaauggaaaguagacaaugcauuacaaucaggaaacucacaagaaucaguaacagaacaagacucaaaagauuccacauacucccuaucaucaaccuuaacacuaucaaaagcagacuacgaaaaacacaaaguauacgcaugcgaaguaacacaccaaggacuaucuucaccaguaacaaaaucauucaauagaggagaaugc

SEQ ID NO: 61707 - RNA, 639 nt, Artificial Sequence
  derived and/or modified sequence opt11 from CDS (LC) w/o signal peptide encoded by mRNA R4182
gacaucguccuaacccaaucccccgccauaauguccgccucacccggcgaaaaagucaccaugaccugcuccgccuccuccucagucggcuacaugcacugguaccaacaaaaaucauccaccucccccaaacucuggaucuacgacaccuccaaacucgcaucaggcguccccggccgcuucuccggcuccggcuccggaaacuccuacucccucaccaucuccuccauccaagccgaagacguagccaccuacuacugcuuccaaggcucuggcuaccccuucaccuucggaggcggaaccaaacucgaaaucaaacgcaccgucgcagcacccuccguauucaucuucccccccuccgacgaacaacucaaaucaggcaccgccuccgucgucugccuccucaacaacuucuacccccgagaagccaaaguccaauggaaaguagacaacgcccuccaauccggaaacucccaagaauccgucaccgaacaagacuccaaagacuccaccuacucccucuccucaacccucacccucuccaaagccgacuacgaaaaacacaaagucuacgccugcgaagucacccaccaaggccucuccucacccgucaccaagucauucaaccgaggcgaaugc

SEQ ID NO: 61708 - protein, 233 aa, Artificial Sequence
  Protein (LC) encoded by mRNA R4182
METPAQLLFLLLLWLPDTTGDIVLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61709 - RNA, 702 nt, Artificial Sequence
  CDS (LC) encoded by mRNA R4182
auggagacccccgcccagcugcucuuccugcugcuccuguggcugccggacaccacgggcgacaucguccugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcuga

SEQ ID NO: 61710 - RNA, 906 nt, Artificial Sequence
  R4182
gggagaaagcuuaccauggagacccccgcccagcugcucuuccugcugcuccuguggcugccggacaccacgggcgacaucguccugacccagagccccgccaucauguccgccagcccgggcgagaaggugaccaugacgugcuccgcgagcuccagcgucggguacaugcacugguaccagcagaaguccagcaccucccccaagcucuggaucuacgacaccagcaagcuggccuccggcgugcccgggcgcuucagcggcuccgggagcggcaacuccuacagccugaccaucuccagcauccaggccgaggacguggccacguacuacugcuuccagggcuccggguaccccuucaccuucggcgggggcaccaagcucgagaucaagcgcaccguggccgcccccagcgucuucaucuucccgcccuccgacgagcagcugaagagcggcaccgcguccguggugugccuccugaacaacuucuacccccgcgaggccaagguccaguggaagguggacaacgcccugcagagcgggaacucccaggagagcgugacggagcaggacuccaaggacagcaccuacucccucagcuccacccugacccugagcaaggccgacuacgagaagcacaaggucuacgccugcgaggugacgcaccaggggcucuccagccccgugaccaaguccuucaaccggggcgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61711 - protein, 446 aa, Artificial Sequence
  Protein (HC) w/o signal peptide encoded by mRNA R3983, R4124
EVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSAETTAPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 61712 - RNA, 1338 nt, Artificial Sequence
  CDS (HC) w/o signal peptide encoded by mRNA R3983, R4124
gagguccagcucgucgagaccggcggcggccucguccagcccggcaacagccucaagcucagcugcgccaccagcggcuucaucuucagcaccaccuggaugaacuggauccggcagacccccggcaagcggcucgaguggcucgcccagaucgaggacaagagcaacaacuacuucaucagcuacagcgagagcgucaagggccgguucaccaucagccgggacgacagcaagagcagcgucuaccuccagaugaacaaccucaaggaggaggacaccgccaucuacuacugcagcuggaaguaccggagcaacuacuacuucgacuacuggggccagggcgucauggucaccgucagcgccgagaccaccgcccccagcguguacccgcuggcgcccggcacggcccucaaguccaacagcauggucacccuggggugccuggugaagggcuacuuccccgagcccgugaccgucaccuggaacuccggggcccucagcuccggcgugcacacguuccccgccgugcugcagagcgggcuguacacccucaccuccagcgucaccgugcccuccagcacguggcccucccagaccgugaccugcaacgucgcccaccccgcgagcuccaccaagguggacaagaagaucgugccgcgcaacugcggcggcgacugcaagcccugcaucugcacggggagcgaggucuccagcguguucaucuucccgcccaagccgaaggacgugcugaccaucacccugacccccaaggucacgugcgugguggucgacaucucccaggacgaccccgaggugcacuucagcugguucguggacgacgucgaggugcacaccgcccagacccggcccccggaggagcaguucaacuccaccuuccgcagcgugagcgagcuccccauccugcaccaggacuggcugaacggccggacguuccgcugcaaggucaccuccgccgccuuccccagccccaucgagaagaccaucuccaagccggaggggcggacccaggugccccacgucuacacgaugagccccaccaaggaggagaugacccagaacgagguguccaucaccugcauggugaagggcuucuacccgcccgacaucuacgucgaguggcagaugaacgggcagccccaggagaacuacaagaacacgccgcccaccauggacaccgacggcagcuacuuccucuacuccaagcugaacgugaagaaggagaaguggcagcagggcaacaccuucacgugcagcgugcugcacgaggggcuccacaaccaccacaccgagaagucccugagccacuccccgggcaag

SEQ ID NO: 61713 - RNA, 1338 nt, Artificial Sequence
  derived and/or modified sequence opt2 from CDS (HC) w/o signal peptide encoded by mRNA R3983, R4124
gagguccagcucgucgagaccggcggcggccucguccagcccggcaacucccucaagcucuccugcgccaccuccggcuucaucuucuccaccaccuggaugaacuggauccgccagacccccggcaagcgccucgaguggcucgcccagaucgaggacaaguccaacaacuacuucaucuccuacuccgaguccgucaagggccgcuucaccaucucccgcgacgacuccaaguccuccgucuaccuccagaugaacaaccucaaggaggaggacaccgccaucuacuacugcuccuggaaguaccgcuccaacuacuacuucgacuacuggggccagggcgucauggucaccgucuccgccgagaccaccgcccccuccgucuacccccucgcccccggcaccgcccucaaguccaacuccauggucacccucggcugccucgucaagggcuacuuccccgagcccgucaccgucaccuggaacuccggcgcccucuccuccggcguccacaccuuccccgccguccuccaguccggccucuacacccucaccuccuccgucaccguccccuccuccaccuggcccucccagaccgucaccugcaacgucgcccaccccgccuccuccaccaaggucgacaagaagaucgucccccgcaacugcggcggcgacugcaagcccugcaucugcaccggcuccgaggucuccuccgucuucaucuucccccccaagcccaaggacguccucaccaucacccucacccccaaggucaccugcgucgucgucgacaucucccaggacgaccccgagguccacuucuccugguucgucgacgacgucgagguccacaccgcccagacccgcccccccgaggagcaguucaacuccaccuuccgcuccgucuccgagcuccccauccuccaccaggacuggcucaacggccgcaccuuccgcugcaaggucaccuccgccgccuuccccucccccaucgagaagaccaucuccaagcccgagggccgcacccaggucccccacgucuacaccaugucccccaccaaggaggagaugacccagaacgaggucuccaucaccugcauggucaagggcuucuacccccccgacaucuacgucgaguggcagaugaacggccagccccaggagaacuacaagaacaccccccccaccauggacaccgacggcuccuacuuccucuacuccaagcucaacgucaagaaggagaaguggcagcagggcaacaccuucaccugcuccguccuccacgagggccuccacaaccaccacaccgagaagucccucucccacucccccggcaag

SEQ ID NO: 61714 - RNA, 1338 nt, Artificial Sequence
  derived and/or modified sequence opt3 from CDS (HC) w/o signal peptide encoded by mRNA R3983, R4124
gaggugcagcuggucgaaaccggcgggggacucguucaacccgguaacagccuuaagcuguccugcgccacaucuggcuucaucuuuucaacuacguggaugaauuggauuagacagaccccugggaaaagguuggagugguuagcucagauagaagacaagaguaacaauuacuucaucagcuauuccgagucugugaaaggacgguuuacaauuucgcgcgaugacucaaagagcaguguauaccugcagaugaacaaucuaaaagaagaggauacugcaaucuauuacuguuccuggaaguaucgaucuaacuacuauuucgacuacuggggccaaggugugauggucaccgugagcgccgagacaaccgcgccauccguuuacccgcucgcucccgggacugcccugaagucaaauaguauggugacacuuggaugccuggucaaaggcuauuuuccugaaccagugaccguaacguggaacagcggcgcauugucuuccgggguucacacuuuccccgccgugcuccagucaggacuguacacccugacaagcagugucacugugccuucuuccaccuggccaagccagacagugaccuguaaugucgcucaucccgcaucgucuacgaagguugauaaaaagauugugccucguaacugcgguggcgacuguaaaccaugcaucuguacuggguccgagguaucaaguguguuuauauucccgcccaagccuaaggauguccucacaaucaccuuaacuccaaaagugacaugcguuguggucgacauuagccaggaugaccccgaagugcacuuuuccugguucguagaugacguugaggugcauaccgcccaaacgagaccuccagaggaacaguuuaauucuaccuucaggagcgucucagagcugcccauccuucaccaggauugguugaacggacggacauuucgcuguaaggugaccagugcugccuucccguccccuauugagaaaacuaucagcaagcccgaaggcagaacacaggucccacauguguauacuaugucuccuaccaaagaagagaugacacaaaaugagguuucaauaaccugcauggugaaggguuucuaucccccagacauuuacguagaauggcagaugaacgggcagccccaagagaauuacaaaaacacuccuccaacgauggacacagauggaaguuauuuucuguacagcaagcuaaacgucaagaaagaaaaguggcagcagggcaauaccuucacuuguuccgugcuccacgagggccugcacaaccaucacaccgaaaaaucucuuucgcauagcccggggaag

SEQ ID NO: 61715 - RNA, 1338 nt, Artificial Sequence
  derived and/or modified sequence opt4 from CDS (HC) w/o signal peptide encoded by mRNA R3983, R4124
gaggugcagcugguggagaccggcggcggccuggugcagcccggcaacagccugaagcugagcugcgccaccagcggcuucaucuucagcaccaccuggaugaacuggaucagacagacccccggcaagagacuggaguggcuggcccagaucgaggacaagagcaacaacuacuucaucagcuacagcgagagcgugaagggcagauucaccaucagcagagacgacagcaagagcagcguguaccugcagaugaacaaccugaaggaggaggacaccgccaucuacuacugcagcuggaaguacagaagcaacuacuacuucgacuacuggggccagggcgugauggugaccgugagcgccgagaccaccgcccccagcguguacccccuggcccccggcaccgcccugaagagcaacagcauggugacccugggcugccuggugaagggcuacuuccccgagcccgugaccgugaccuggaacagcggcgcccugagcagcggcgugcacaccuuccccgccgugcugcagagcggccuguacacccugaccagcagcgugaccgugcccagcagcaccuggcccagccagaccgugaccugcaacguggcccaccccgccagcagcaccaagguggacaagaagaucgugcccagaaacugcggcggcgacugcaagcccugcaucugcaccggcagcgaggugagcagcguguucaucuucccccccaagcccaaggacgugcugaccaucacccugacccccaaggugaccugcguggugguggacaucagccaggacgaccccgaggugcacuucagcugguucguggacgacguggaggugcacaccgcccagaccagaccccccgaggagcaguucaacagcaccuucagaagcgugagcgagcugcccauccugcaccaggacuggcugaacggcagaaccuucagaugcaaggugaccagcgccgccuuccccagccccaucgagaagaccaucagcaagcccgagggcagaacccaggugccccacguguacaccaugagccccaccaaggaggagaugacccagaacgaggugagcaucaccugcauggugaagggcuucuacccccccgacaucuacguggaguggcagaugaacggccagccccaggagaacuacaagaacaccccccccaccauggacaccgacggcagcuacuuccuguacagcaagcugaacgugaagaaggagaaguggcagcagggcaacaccuucaccugcagcgugcugcacgagggccugcacaaccaccacaccgagaagagccugagccacagccccggcaag

SEQ ID NO: 61716 - RNA, 1338 nt, Artificial Sequence
  derived and/or modified sequence opt5 from CDS (HC) w/o signal peptide encoded by mRNA R3983, R4124
gaggugcagcuggucgaaaccggcgggggacucguucaacccggcaacagccugaaacuuuccugcgccacaucuggguucaucuuuagcacgaccuggaugaauuggauuagacagacaccuggaaaacggcuggaguggcucgcucagaucgaagacaaguccaacaauuacuucauuucuuauagcgaguccgugaaaggccgcuuuaccaucucuagagaugacagcaaguccagcguguaccugcagaugaacaaucuuaaagaagaggauacagccauuuauuacuguucuuggaaguaucgguccaacuacuauuucgacuacugggggcaaggagucauggugaccguuagcgcggagacaaccgcuccgucuguguacccccuggccccuggcacggcccucaaguccaauagcauggucacccugggcugccuggugaaaggguauuuucccgaaccuguuacagugaccuggaacucuggagcucucuccagcggcguccacacauuccccgccgugcugcaguccgggcuuuacacccugacgucuagcgugacagucccuuccagcaccuggccgucucagacaguuaccuguaauguggcucaucccgccuccagcaccaagguggauaaaaagaucgucccucgcaacugcggaggcgacuguaaacccugcaucuguacagggucugaggugagcuccguuuuuauuuucccucccaagccgaaggaugugcucacgaucacccugacaccuaaagugaccugcgucguuguggacauuucucaggaugaccccgaaguccacuuuagcugguucguggaugacgucgaggugcauacagcgcaaaccagaccucccgaggaacaguuuaauuccacguuccggagcguuucugagcuucccauccugcaccaggauuggcucaacggacgcacauuuagauguaaggugaccuccgccgcuuucccuagcccgauugaaaagaccaucucuaagcccgagggccggacacaggucccucauguguauaccaugucccccacaaaagaagagaugacgcaaaaugagguuagcauuaccugcauggugaagggcuucuacccucccgacaucuaugucgaauggcagaugaacgggcagccgcaagagaauuacaaaaacacaccucccaccauggacacagauggauccuauuuucuguacucuaagcugaacgugaagaaagaaaaguggcagcagggcaauaccuucacguguagcgugcuccacgaggggcugcacaaccaucacaccgaaaaaucccuuucucauagcccuggaaag

SEQ ID NO: 61717 - RNA, 1338 nt, Artificial Sequence
  derived and/or modified sequence opt6 from CDS (HC) w/o signal peptide encoded by mRNA R3983, R4124
gaaguacaauuaguagaaacuggaggaggauuaguacaaccuggaaauucacuaaaacuaucaugcgcaaccucaggauucauauucucaacaacauggaugaauuggauccgacaaacaccaggaaaaagacucgaaugguuagcacaaauagaagacaaaucaaauaacuacuuuauuucauacucagaaucaguuaaaggaagauuuacaauaucacgagacgacuccaaaucaucagucuaccuacaaaugaacaacuuaaaagaagaagacacagccaucuauuauugcucauggaaauacagaucuaauuacuacuuugacuacuggggacaaggcguaaugguaacagucuccgcagaaacaacugccccuuccguauauccacuagcaccaggaacagcacuaaaaucuaacucaaugguaacacuuggcugccuaguaaaaggcuauuucccugaaccaguaacaguaacuuggaacucaggagcauuaucaucaggaguccacacauucccagccguauuacaaucaggauuauacacacuaacauccucuguaacaguucccucaucaacauggccaucucaaaccguaacauguaauguagcacauccagccuccucuaccaaaguagacaaaaaaaucgucccacgaaacugcggaggugacugcaaaccauguaucuguacaggcucagaaguaucaucaguauuuaucuucccaccaaaaccuaaagaugucuuaaccauaacacuuacuccaaaaguaacaugugucguuguugacauaucccaagaugacccagaaguccacuucuccugguucguagacgauguagaaguucauacagcucaaacacgaccaccagaagaacaauucaacuccaccuuuaggucaguauccgaauuacccauacuccaccaagacuggcuaaacggccgaacauucagauguaaaguaacaagugcagcauuuccuucuccaaucgaaaaaacuauaucaaaacccgaaggacgaacccaagucccacacguauauacaaugucaccaaccaaagaagaaaugacacaaaacgaaguaucuauaacaugcaugguaaaaggcuucuauccaccagacauauauguagaauggcaaaugaauggacaaccucaagaaaauuauaaaaauacaccaccaacuauggacacagacggaucauacuuccuauacucaaaacuaaacguaaaaaaagaaaaauggcaacaaggcaacacuuucacauguucaguacuacacgaaggcuuacauaaccaucacacagaaaaaucacucucccauucaccaggcaaa

SEQ ID NO: 61718 - RNA, 1338 nt, Artificial Sequence
  derived and/or modified sequence opt11 from CDS (HC) w/o signal peptide encoded by mRNA R3983, R4124
gaaguccaacucguagaaaccggcggcggacuuguccaacccggcaacucccucaaacuaucaugugcaaccucaggcuucauauucuccaccacauggaugaacuggauccgccaaacacccggaaaacgccuagaauggcucgcacaaaucgaagauaaauccaacaacuacuucaucucguacuccgaauccgucaaaggacgauucacaaucucccgcgacgacuccaaaucaucagucuacuuacaaaugaacaaccucaaagaagaagacacagcaauauacuacugcuccuggaaauaccgcuccaacuacuacuucgacuacuggggccagggcgucauggucaccgucuccgcagaaaccacagcccccuccgucuacccucucgcccccggcacagcucucaaguccaacuccauggucacacuaggcugccucgucaaaggauacuuccccgaacccguaacaguaacauggaacuccggugcccuaucaagcggcguccacacauuccccgccguccuccaauccggccucuacacccuaacaagcuccguaaccguacccuccuccaccuggccuucacaaacagucaccugcaacgucgcccaccccgcaucaucaacgaaagucgacaaaaaaauuguaccucgcaacugcggaggcgacugcaaaccaugcaucugcaccggcuccgaaguuuccucaguauucaucuucccacccaaacccaaagacguacuuacaaucacacucacacccaaaguaacaugcgucgucgucgacauuucccaggacgacccagaaguacacuucucgugguucguagacgacgucgaaguccacacagcccaaaccagaccccccgaagaacaauucaacucuaccuuucgcuccguuuccgaacucccaauacuucaccaagacuggcuaaacggacgaacguuccgcugcaaagucaccuccgcagccuucccaagccccaucgaaaaaaccaucuccaaacccgaaggccgcacccaaguaccccacgucuacaccauguccccaaccaaagaagaaaugacccaaaacgaaguuucgaucacuugcauggucaaaggcuucuaccccccagacaucuacgucgaauggcaaaugaacggccaaccccaagaaaacuauaaaaacaccccccccacaauggacaccgacggcucauacuuccuauacucaaaacuaaacgucaaaaaagaaaaauggcaacaaggaaacacguucacaugcuccguccugcacgaaggacuccacaaccaccacaccgaaaaaucccuaucccacuccccaggaaaa

SEQ ID NO: 61719 - protein, 471 aa, Artificial Sequence
  Protein (HC) encoded by mRNA R3983, R4124
MAVMAPRTLVLLLSGALALTQTWAGEVQLVETGGGLVQPGNSLKLSCATSGFIFSTTWMNWIRQTPGKRLEWLAQIEDKSNNYFISYSESVKGRFTISRDDSKSSVYLQMNNLKEEDTAIYYCSWKYRSNYYFDYWGQGVMVTVSAETTAPSVYPLAPGTALKSNSMVTLGCLVKGYFPEPVTVTWNSGALSSGVHTFPAVLQSGLYTLTSSVTVPSSTWPSQTVTCNVAHPASSTKVDKKIVPRNCGGDCKPCICTGSEVSSVFIFPPKPKDVLTITLTPKVTCVVVDISQDDPEVHFSWFVDDVEVHTAQTRPPEEQFNSTFRSVSELPILHQDWLNGRTFRCKVTSAAFPSPIEKTISKPEGRTQVPHVYTMSPTKEEMTQNEVSITCMVKGFYPPDIYVEWQMNGQPQENYKNTPPTMDTDGSYFLYSKLNVKKEKWQQGNTFTCSVLHEGLHNHHTEKSLSHSPGK

SEQ ID NO: 61720 - RNA, 1416 nt, Artificial Sequence
  CDS (HC) encoded by mRNA R3983, R4124
auggccgugauggccccgcggacccugguccuccugcugagcggcgcgcucgcccugacccagacgugggccggggagguccagcucgucgagaccggcggcggccucguccagcccggcaacagccucaagcucagcugcgccaccagcggcuucaucuucagcaccaccuggaugaacuggauccggcagacccccggcaagcggcucgaguggcucgcccagaucgaggacaagagcaacaacuacuucaucagcuacagcgagagcgucaagggccgguucaccaucagccgggacgacagcaagagcagcgucuaccuccagaugaacaaccucaaggaggaggacaccgccaucuacuacugcagcuggaaguaccggagcaacuacuacuucgacuacuggggccagggcgucauggucaccgucagcgccgagaccaccgcccccagcguguacccgcuggcgcccggcacggcccucaaguccaacagcauggucacccuggggugccuggugaagggcuacuuccccgagcccgugaccgucaccuggaacuccggggcccucagcuccggcgugcacacguuccccgccgugcugcagagcgggcuguacacccucaccuccagcgucaccgugcccuccagcacguggcccucccagaccgugaccugcaacgucgcccaccccgcgagcuccaccaagguggacaagaagaucgugccgcgcaacugcggcggcgacugcaagcccugcaucugcacggggagcgaggucuccagcguguucaucuucccgcccaagccgaaggacgugcugaccaucacccugacccccaaggucacgugcgugguggucgacaucucccaggacgaccccgaggugcacuucagcugguucguggacgacgucgaggugcacaccgcccagacccggcccccggaggagcaguucaacuccaccuuccgcagcgugagcgagcuccccauccugcaccaggacuggcugaacggccggacguuccgcugcaaggucaccuccgccgccuuccccagccccaucgagaagaccaucuccaagccggaggggcggacccaggugccccacgucuacacgaugagccccaccaaggaggagaugacccagaacgagguguccaucaccugcauggugaagggcuucuacccgcccgacaucuacgucgaguggcagaugaacgggcagccccaggagaacuacaagaacacgccgcccaccauggacaccgacggcagcuacuuccucuacuccaagcugaacgugaagaaggagaaguggcagcagggcaacaccuucacgugcagcgugcugcacgaggggcuccacaaccaccacaccgagaagucccugagccacuccccgggcaaguga

SEQ ID NO: 61721 - RNA, 1620 nt, Artificial Sequence
  R4124
gggagaaagcuuaccauggccgugauggccccgcggacccugguccuccugcugagcggcgcgcucgcccugacccagacgugggccggggagguccagcucgucgagaccggcggcggccucguccagcccggcaacagccucaagcucagcugcgccaccagcggcuucaucuucagcaccaccuggaugaacuggauccggcagacccccggcaagcggcucgaguggcucgcccagaucgaggacaagagcaacaacuacuucaucagcuacagcgagagcgucaagggccgguucaccaucagccgggacgacagcaagagcagcgucuaccuccagaugaacaaccucaaggaggaggacaccgccaucuacuacugcagcuggaaguaccggagcaacuacuacuucgacuacuggggccagggcgucauggucaccgucagcgccgagaccaccgcccccagcguguacccgcuggcgcccggcacggcccucaaguccaacagcauggucacccuggggugccuggugaagggcuacuuccccgagcccgugaccgucaccuggaacuccggggcccucagcuccggcgugcacacguuccccgccgugcugcagagcgggcuguacacccucaccuccagcgucaccgugcccuccagcacguggcccucccagaccgugaccugcaacgucgcccaccccgcgagcuccaccaagguggacaagaagaucgugccgcgcaacugcggcggcgacugcaagcccugcaucugcacggggagcgaggucuccagcguguucaucuucccgcccaagccgaaggacgugcugaccaucacccugacccccaaggucacgugcgugguggucgacaucucccaggacgaccccgaggugcacuucagcugguucguggacgacgucgaggugcacaccgcccagacccggcccccggaggagcaguucaacuccaccuuccgcagcgugagcgagcuccccauccugcaccaggacuggcugaacggccggacguuccgcugcaaggucaccuccgccgccuuccccagccccaucgagaagaccaucuccaagccggaggggcggacccaggugccccacgucuacacgaugagccccaccaaggaggagaugacccagaacgagguguccaucaccugcauggugaagggcuucuacccgcccgacaucuacgucgaguggcagaugaacgggcagccccaggagaacuacaagaacacgccgcccaccauggacaccgacggcagcuacuuccucuacuccaagcugaacgugaagaaggagaaguggcagcagggcaacaccuucacgugcagcgugcugcacgaggggcuccacaaccaccacaccgagaagucccugagccacuccccgggcaagugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61722 - protein, 217 aa, Artificial Sequence
  Protein (LC) w/o signal peptide encoded by mRNA R3983, R4125
DIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKRADAAPTVSIFPPSTEQLATGGASVVCLMNNFYPRDISVKWKIDGTERRDGVLDSVTDQDSKDSTYSMSSTLSLTKADYESHNLYTCEVVHKTSSSPVVKSFNRNEC

SEQ ID NO: 61723 - RNA, 651 nt, Artificial Sequence
  CDS (LC) w/o signal peptide encoded by mRNA R3983, R4125
gacaucgugcugacccagagccccgcccucgccgucucccuggagcagcgcgcgaccaucagcugcaagacgucccagaacguggacuacuacggcaucagcuaccugcacugguaccagcagaagccggggcagcagcccaagcuccugaucuacgagggcuccaaccuggccagcgggauccccgcccgguucuccggcagcggguccggcaccgacuucacccucaccaucgaccccguggaggccgacgacaucgucacguacuacugccagcagagcaaggacuacccguacaccuucggcgccgggaccaagcuggagcugaagcgcgccgacgcggcccccaccgugagcaucuucccgcccagcaccgagcagcucgccacgggcggggccuccgucgugugccugaugaacaacuucuacccgcgggacaucagcgugaaguggaagaucgacggcaccgagcgccgggacggcguccuggacuccgugaccgaccaggacagcaaggacuccaccuacagcauguccagcacgcucucccugaccaaggcggacuacgagagccacaaccuguacaccugcgaggugguccacaagaccuccagcucccccguggugaagagcuucaaccgcaacgagugc

SEQ ID NO: 61724 - RNA, 651 nt, Artificial Sequence
  derived and/or modified sequence opt2 from CDS (LC) w/o signal peptide encoded by mRNA R3983, R4125
gacaucguccucacccagucccccgcccucgccgucucccucgagcagcgcgccaccaucuccugcaagaccucccagaacgucgacuacuacggcaucuccuaccuccacugguaccagcagaagcccggccagcagcccaagcuccucaucuacgagggcuccaaccucgccuccggcauccccgcccgcuucuccggcuccggcuccggcaccgacuucacccucaccaucgaccccgucgaggccgacgacaucgucaccuacuacugccagcaguccaaggacuaccccuacaccuucggcgccggcaccaagcucgagcucaagcgcgccgacgccgcccccaccgucuccaucuucccccccuccaccgagcagcucgccaccggcggcgccuccgucgucugccucaugaacaacuucuacccccgcgacaucuccgucaaguggaagaucgacggcaccgagcgccgcgacggcguccucgacuccgucaccgaccaggacuccaaggacuccaccuacuccauguccuccacccucucccucaccaaggccgacuacgagucccacaaccucuacaccugcgaggucguccacaagaccuccuccucccccgucgucaaguccuucaaccgcaacgagugc

SEQ ID NO: 61725 - RNA, 651 nt, Artificial Sequence
  derived and/or modified sequence opt3 from CDS (LC) w/o signal peptide encoded by mRNA R3983, R4125
gacaucgugcugacccagagccccgcccucgcugugucccuugagcaaagagcaacaauuucuugcaagacuucacagaacguugauuacuauggcauaaguuaccugcacugguaucagcagaaaccugggcaacagccaaaguuguuaaucuacgaaggaagcaaucuggccuccgguauuccggcgagguucucuggcucggggucaggaacggacuuuacccuaacaaucgaucccguggaggcugacgauauuguaacuuauuacugucagcagagcaaagacuauccuuacaccuucggcgccgguacaaagcucgaacugaaacgggcagaugccgcuccaaccgugaguaucuuucccccuuccacugagcaacuugcaacagggggagccucugucgugugccugaugaacaauuucuacccacgcgacauaagcguuaaguggaagaucgauggcaccgaacgacgugacggcguguuggauuccgucacggaccaggauucaaaagacaguacuuauagcaugucuuccacccucucacugacaaaggcugacuacgagagccauaaccuguauacuugugaggugguacacaaaaccaguucuucccccguugucaagagcuuuaauagaaacgaaugc

SEQ ID NO: 61726 - RNA, 651 nt, Artificial Sequence
  derived and/or modified sequence opt4 from CDS (LC) w/o signal peptide encoded by mRNA R3983, R4125
gacaucgugcugacccagagccccgcccuggccgugagccuggagcagagagccaccaucagcugcaagaccagccagaacguggacuacuacggcaucagcuaccugcacugguaccagcagaagcccggccagcagcccaagcugcugaucuacgagggcagcaaccuggccagcggcauccccgccagauucagcggcagcggcagcggcaccgacuucacccugaccaucgaccccguggaggccgacgacaucgugaccuacuacugccagcagagcaaggacuaccccuacaccuucggcgccggcaccaagcuggagcugaagagagccgacgccgcccccaccgugagcaucuucccccccagcaccgagcagcuggccaccggcggcgccagcguggugugccugaugaacaacuucuaccccagagacaucagcgugaaguggaagaucgacggcaccgagagaagagacggcgugcuggacagcgugaccgaccaggacagcaaggacagcaccuacagcaugagcagcacccugagccugaccaaggccgacuacgagagccacaaccuguacaccugcgagguggugcacaagaccagcagcagccccguggugaagagcuucaacagaaacgagugc

SEQ ID NO: 61727 - RNA, 651 nt, Artificial Sequence
  derived and/or modified sequence opt5 from CDS (LC) w/o signal peptide encoded by mRNA R3983, R4125
gacaucgugcugacccagagccccgcccucgcugucucccuggagcaaagagccacaauuucuugcaagacgagccagaacguugauuacuauggcaucuccuaccuucacugguaucagcagaaaccugggcaacagccgaagcugcucauuuacgaaggaucuaaucuggcgagcggcauccccgcucgguucuccgggucuggaagcggcaccgacuuuacacuuaccauugauccuguggaggccgacgauaucgugacauauuacugucagcaguccaaagacuaucccuacaccuucggggccggaacaaagcuggaacucaaacgcgcugaugccgcuccuaccgucagcaucuuucccccuucuacggagcaacuggccaccggcggcgcguccgugguuugccugaugaacaauuucuacccgagagacauuagcgugaaguggaagaucgaugggacagaacggcgcgacggaguccucgauucugugaccgaccaggauuccaaagacagcacauauucuauguccagcacccugucccuuacgaaggccgacuacgagucucauaaccuguauacaugugagguugugcacaaaaccagcuccagccccgucgugaagucuuuuaauagaaacgaaugc

SEQ ID NO: 61728 - RNA, 651 nt, Artificial Sequence
  derived and/or modified sequence opt6 from CDS (LC) w/o signal peptide encoded by mRNA R3983, R4125
gacauaguauuaacacaaucaccagcacuagcaguaucacuagaacaaagagcaacaauauccugcaaaacaucccaaaacguagacuacuacggaauaucuuaccuacacugguaccaacaaaaaccaggacaacaaccaaaacuacuaaucuacgaaggaucaaaccuagcaucaggaauaccagcaagauucucaggaucaggauccggaacagacuucacacuaacaauagacccaguagaagcagacgauauaguaacauacuacugccaacaaucaaaagacuacccauacacauucggagcaggaacuaaauuagaauuaaaaagagccgacgcagcaccaacaguaucaauauucccaccaucaacagaacaauuagccacaggaggagcaucaguagucugccuaaugaacaacuucuacccccgagacauuucaguaaaauggaaaauagacggaacagaaagaagagacggaguacuagacucuguaacagaccaagacucaaaagacucaaccuacucaaugucuucaacccuaucacuaacaaaagcagacuacgaaucccacaaucuauacacaugcgaaguaguacacaaaacaucauccucaccaguaguaaaaucauucaacagaaacgaaugc

SEQ ID NO: 61729 - RNA, 651 nt, Artificial Sequence
  derived and/or modified sequence opt11 from CDS (LC) w/o signal peptide encoded by mRNA R3983, R4125
gacaucguccucacccaaucccccgcccucgccgucucucucgaacaacgcgccaccaucuccugcaaaaccucacaaaacgucgacuacuacggcaucuccuaccuccacugguaccaacaaaaacccggccaacaacccaaacuccuaaucuacgaaggcagcaaucuagccuccggcauacccgcccgcuuuucagguucaggcucuggcaccgacuucacccucaccauagaccccgucgaagccgacgacauagucaccuacuacugccaacaauccaaagacuaccccuacaccuucggcgccggcaccaaacucgaacucaaacgcgccgacgccgcccccaccgucuccaucuucccacccuccaccgaacaacuagcaaccggcggcgccucagucgucugccucaugaacaacuucuacccccgcgacaucuccgucaaauggaaaaucgacggcacagaacgccgugacggcguccuugacuccgucacagaccaagacuccaaagacuccaccuacuccauguccuccacccuaucccuaaccaaagccgacuacgaaucccacaaccucuacacaugcgaagucguccacaaaaccuccucaucacccgucgucaaauccuucaaccgcaacgaaugc

SEQ ID NO: 61730 - protein, 242 aa, Artificial Sequence
  Protein (LC) encoded by mRNA R3983, R4125
MAVMAPRTLVLLLSGALALTQTWAGDIVLTQSPALAVSLEQRATISCKTSQNVDYYGISYLHWYQQKPGQQPKLLIYEGSNLASGIPARFSGSGSGTDFTLTIDPVEADDIVTYYCQQSKDYPYTFGAGTKLELKRADAAPTVSIFPPSTEQLATGGASVVCLMNNFYPRDISVKWKIDGTERRDGVLDSVTDQDSKDSTYSMSSTLSLTKADYESHNLYTCEVVHKTSSSPVVKSFNRNEC

SEQ ID NO: 61731 - RNA, 729 nt, Artificial Sequence
  CDS (LC) encoded by mRNA R3983, R4125
auggccgugauggccccgcggacccugguccuccugcugagcggcgcgcucgcccugacccagacgugggccggggacaucgugcugacccagagccccgcccucgccgucucccuggagcagcgcgcgaccaucagcugcaagacgucccagaacguggacuacuacggcaucagcuaccugcacugguaccagcagaagccggggcagcagcccaagcuccugaucuacgagggcuccaaccuggccagcgggauccccgcccgguucuccggcagcggguccggcaccgacuucacccucaccaucgaccccguggaggccgacgacaucgucacguacuacugccagcagagcaaggacuacccguacaccuucggcgccgggaccaagcuggagcugaagcgcgccgacgcggcccccaccgugagcaucuucccgcccagcaccgagcagcucgccacgggcggggccuccgucgugugccugaugaacaacuucuacccgcgggacaucagcgugaaguggaagaucgacggcaccgagcgccgggacggcguccuggacuccgugaccgaccaggacagcaaggacuccaccuacagcauguccagcacgcucucccugaccaaggcggacuacgagagccacaaccuguacaccugcgaggugguccacaagaccuccagcucccccguggugaagagcuucaaccgcaacgagugcuga

SEQ ID NO: 61732 - RNA, 933 nt, Artificial Sequence
  R4125
gggagaaagcuuaccauggccgugauggccccgcggacccugguccuccugcugagcggcgcgcucgcccugacccagacgugggccggggacaucgugcugacccagagccccgcccucgccgucucccuggagcagcgcgcgaccaucagcugcaagacgucccagaacguggacuacuacggcaucagcuaccugcacugguaccagcagaagccggggcagcagcccaagcuccugaucuacgagggcuccaaccuggccagcgggauccccgcccgguucuccggcagcggguccggcaccgacuucacccucaccaucgaccccguggaggccgacgacaucgucacguacuacugccagcagagcaaggacuacccguacaccuucggcgccgggaccaagcuggagcugaagcgcgccgacgcggcccccaccgugagcaucuucccgcccagcaccgagcagcucgccacgggcggggccuccgucgugugccugaugaacaacuucuacccgcgggacaucagcgugaaguggaagaucgacggcaccgagcgccgggacggcguccuggacuccgugaccgaccaggacagcaaggacuccaccuacagcauguccagcacgcucucccugaccaaggcggacuacgagagccacaaccuguacaccugcgaggugguccacaagaccuccagcucccccguggugaagagcuucaaccgcaacgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuagacaauuggaauu

SEQ ID NO: 61733 - RNA, 2822 nt, Artificial Sequence
  CDS (HC)-IRES-CDS (LC) as RNA from mRNA R3983
auggccgugauggccccgcggacccugguccuccugcugagcggcgcgcucgcccugacccagacgugggccggggagguccagcucgucgagaccggcggcggccucguccagcccggcaacagccucaagcucagcugcgccaccagcggcuucaucuucagcaccaccuggaugaacuggauccggcagacccccggcaagcggcucgaguggcucgcccagaucgaggacaagagcaacaacuacuucaucagcuacagcgagagcgucaagggccgguucaccaucagccgggacgacagcaagagcagcgucuaccuccagaugaacaaccucaaggaggaggacaccgccaucuacuacugcagcuggaaguaccggagcaacuacuacuucgacuacuggggccagggcgucauggucaccgucagcgccgagaccaccgcccccagcguguacccgcuggcgcccggcacggcccucaaguccaacagcauggucacccuggggugccuggugaagggcuacuuccccgagcccgugaccgucaccuggaacuccggggcccucagcuccggcgugcacacguuccccgccgugcugcagagcgggcuguacacccucaccuccagcgucaccgugcccuccagcacguggcccucccagaccgugaccugcaacgucgcccaccccgcgagcuccaccaagguggacaagaagaucgugccgcgcaacugcggcggcgacugcaagcccugcaucugcacggggagcgaggucuccagcguguucaucuucccgcccaagccgaaggacgugcugaccaucacccugacccccaaggucacgugcgugguggucgacaucucccaggacgaccccgaggugcacuucagcugguucguggacgacgucgaggugcacaccgcccagacccggcccccggaggagcaguucaacuccaccuuccgcagcgugagcgagcuccccauccugcaccaggacuggcugaacggccggacguuccgcugcaaggucaccuccgccgccuuccccagccccaucgagaagaccaucuccaagccggaggggcggacccaggugccccacgucuacacgaugagccccaccaaggaggagaugacccagaacgagguguccaucaccugcauggugaagggcuucuacccgcccgacaucuacgucgaguggcagaugaacgggcagccccaggagaacuacaagaacacgccgcccaccauggacaccgacggcagcuacuuccucuacuccaagcugaacgugaagaaggagaaguggcagcagggcaacaccuucacgugcagcgugcugcacgaggggcuccacaaccaccacaccgagaagucccugagccacuccccgggcaagugaaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggacaucgugcugacccagagccccgcccucgccgucucccuggagcagcgcgcgaccaucagcugcaagacgucccagaacguggacuacuacggcaucagcuaccugcacugguaccagcagaagccggggcagcagcccaagcuccugaucuacgagggcuccaaccuggccagcgggauccccgcccgguucuccggcagcggguccggcaccgacuucacccucaccaucgaccccguggaggccgacgacaucgucacguacuacugccagcagagcaaggacuacccguacaccuucggcgccgggaccaagcuggagcugaagcgcgccgacgcggcccccaccgugagcaucuucccgcccagcaccgagcagcucgccacgggcggggccuccgucgugugccugaugaacaacuucuacccgcgggacaucagcgugaaguggaagaucgacggcaccgagcgccgggacggcguccuggacuccgugaccgaccaggacagcaaggacuccaccuacagcauguccagcacgcucucccugaccaaggcggacuacgagagccacaaccuguacaccugcgaggugguccacaagaccuccagcucccccguggugaagagcuucaaccgcaacgagugcuga

SEQ ID NO: 61734 - RNA, 3014 nt, Artificial Sequence
  R3983
gggagaaagcuuaccauggccgugauggccccgcggacccugguccuccugcugagcggcgcgcucgcccugacccagacgugggccggggagguccagcucgucgagaccggcggcggccucguccagcccggcaacagccucaagcucagcugcgccaccagcggcuucaucuucagcaccaccuggaugaacuggauccggcagacccccggcaagcggcucgaguggcucgcccagaucgaggacaagagcaacaacuacuucaucagcuacagcgagagcgucaagggccgguucaccaucagccgggacgacagcaagagcagcgucuaccuccagaugaacaaccucaaggaggaggacaccgccaucuacuacugcagcuggaaguaccggagcaacuacuacuucgacuacuggggccagggcgucauggucaccgucagcgccgagaccaccgcccccagcguguacccgcuggcgcccggcacggcccucaaguccaacagcauggucacccuggggugccuggugaagggcuacuuccccgagcccgugaccgucaccuggaacuccggggcccucagcuccggcgugcacacguuccccgccgugcugcagagcgggcuguacacccucaccuccagcgucaccgugcccuccagcacguggcccucccagaccgugaccugcaacgucgcccaccccgcgagcuccaccaagguggacaagaagaucgugccgcgcaacugcggcggcgacugcaagcccugcaucugcacggggagcgaggucuccagcguguucaucuucccgcccaagccgaaggacgugcugaccaucacccugacccccaaggucacgugcgugguggucgacaucucccaggacgaccccgaggugcacuucagcugguucguggacgacgucgaggugcacaccgcccagacccggcccccggaggagcaguucaacuccaccuuccgcagcgugagcgagcuccccauccugcaccaggacuggcugaacggccggacguuccgcugcaaggucaccuccgccgccuuccccagccccaucgagaagaccaucuccaagccggaggggcggacccaggugccccacgucuacacgaugagccccaccaaggaggagaugacccagaacgagguguccaucaccugcauggugaagggcuucuacccgcccgacaucuacgucgaguggcagaugaacgggcagccccaggagaacuacaagaacacgccgcccaccauggacaccgacggcagcuacuuccucuacuccaagcugaacgugaagaaggagaaguggcagcagggcaacaccuucacgugcagcgugcugcacgaggggcuccacaaccaccacaccgagaagucccugagccacuccccgggcaagugaaugcauuugaaagccgggggugggagauccggauugccagucugcucgauaucgcaggcuggguccgugacuacccacucccccuuuaauuccgccccucucccuccccccccccuaacguuacuggccgaagccgcuuggaauaaggccggugugcguuugucuauauguuauuuuccaccauauugccgucuuuuggcaaugugagggcccggaaaccuggcccugucuucuugacgagcauuccuaggggucuuuccccucucgccaaaggaaugcaaggucuguugaaugucgugaaggaagcaguuccucuggaagcuucuugaagacaaacaacgucuguagcgacccuuugcaggcagcggaaccccccaccuggcgacaggugccucugcggccaaaagccacguguauaagauacaccugcaaaggcggcacaaccccagugccacguugugaguuggauaguuguggaaagagucaaauggcucuccucaagcguauucaacaaggggcugaaggaugcccagaagguaccccauuguaugggaucugaucuggggccucggugcacaugcuuuacguguguuuagucgagguuaaaaaacgucuaggccccccgaaccacggggacgugguuuuccuuugaaaaacacgaugauaauagaucuaccauggccgugauggccccgcggacccugguccuccugcugagcggcgcgcucgcccugacccagacgugggccggggacaucgugcugacccagagccccgcccucgccgucucccuggagcagcgcgcgaccaucagcugcaagacgucccagaacguggacuacuacggcaucagcuaccugcacugguaccagcagaagccggggcagcagcccaagcuccugaucuacgagggcuccaaccuggccagcgggauccccgcccgguucuccggcagcggguccggcaccgacuucacccucaccaucgaccccguggaggccgacgacaucgucacguacuacugccagcagagcaaggacuacccguacaccuucggcgccgggaccaagcuggagcugaagcgcgccgacgcggcccccaccgugagcaucuucccgcccagcaccgagcagcucgccacgggcggggccuccgucgugugccugaugaacaacuucuacccgcgggacaucagcgugaaguggaagaucgacggcaccgagcgccgggacggcguccuggacuccgugaccgaccaggacagcaaggacuccaccuacagcauguccagcacgcucucccugaccaaggcggacuacgagagccacaaccuguacaccugcgaggugguccacaagaccuccagcucccccguggugaagagcuucaaccgcaacgagugcugaggacuaguuauaagacugacuagcccgaugggccucccaacgggcccuccuccccuccuugcaccgagauuaauaaaaaaaaaaaaaaaaaaaaaaaaaaaaaaaaaaaaaaaaaaaaaaaaaaaaaaaaaaaaaaaauauuccccccccccccccccccccccccccccccucuag
